United States Patent 10,463,711 (NUTRITIVE POLYPEPTIDES AND FORMULATIONS THEREOF, AND METHODS OF PRODUCTION AND USE THEREOF) - sequence listing, part 5

SEQ ID NO: 28553 - protein, 576 aa, Bacillus licheniformis
SLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDYSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWLWRLIGGCE

SEQ ID NO: 28554 - protein, 598 aa, Bacillus licheniformis
MNIVLVNKSKKFFVFSFIFVMLLSLSFVNGEVAKADSGKNYKIIGYYPSWGAYGRNFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPVARGNFAASAVEFLRKYGFDGVDLDWEYPVSGGLPGNSTRPEDKRNYTLLLQEVRKKLDAAEAKDGKEYLLTIASGASPEYVSNTELDKIAQTVDWINIMTYDFNGGWQSISAHNAPLFYDPKAKEAGVPNAETYNIENTVKRYKEAGVKGDKLVLGTPFYGRGWSGCESGGHGEYQKCGPAKEGTWENGVFDFSDLEKNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVNLAWDAPSSGANITEYVVSFENRSISVKETSAEIGNLKPGMAYSFTVSAKDADGELHTGPTVKVTTNSDQACSYDEWKETNAYTGGERVAFNGKVYEAKWWTKGDRPDQSGEWGVWRLVGGCE

SEQ ID NO: 28555 - protein, 222 aa, Bacillus licheniformis
MMKRLAGTVILSGLLVCGFGQALPEKASAAEVVHKTIVVEKGQTYDGKGKRLIAGPELGDGSQREDQKPIFKVENGATLKNVVLGAPAADGVHTYGNASISNVVWEDVGEDALTVKSEGNVTINGGSARLAADKIFQINKASTFTVKNFTADQGGKFIRQLGGSTFKAVVNIDNCTITNMKEAIFRTDSSTSSVTMTNTRYSKVGKKWIGVKHITERNNHEF

SEQ ID NO: 28556 - protein, 379 aa, Bacillus licheniformis
MMRKKSFWLGMLTAFMLVFTMAFSDSASAAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGTYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 28557 - protein, 274 aa, Bacillus licheniformis
AQTVPYGIPLIKADKVQAQGYKGANVKVGIIDTGIAASHTDLKVVGGASFVSGESYNTDGNGHGTHVAGTVAALDNTTGVLGVAPNVSLYAIKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGAELEVMAPGVSVYSTYPSNTYTSLNGTSMASPHVAGAAALILSKYPTLSASQVRNRLSSTATNLGDSFYYGKGLINVEAAAQ

SEQ ID NO: 28558 - protein, 718 aa, Bacillus licheniformis
MFQMAKRVLLSTTLTFSLLAGSALPFLPASAIYADADTAVTNKQNFSTDVIYQVFTDRFLDGNPSNNPTGAAFDGTCSNLKLYCGGDWQGLVNKINDNYFSDLGVTALWISQPVENIFATINYSGVTNTAYHGYWARDFKKTNPYFGTMTDFQNLVTTAHAKGIKIIIDFAPNHTSPAMETDTSFAENGKLYDNGNLVGGYTNDTNGYFHHNGGSDFSTLENGIYKNLYDLADLNHNNSTIDTYFKDAIKLWLDMGVDGIRVDAVKHMPQGWQKNWMSSIYAHKPVFTFGEWFLGSAAPDADNTDFANESGMSLLDFRFNSAVRNVFRDNTSNMYALDSMLTATAADYNQVNDQVTFIDNHDMDRFKTSAVNNRRLEQALAFTLTSRGVPAIYYGTEQYLTGNGDPDNRGKMPSFSKSTTAFNVISKLAPLRKSNPAIAYGSTQQRWINNDVYIYERKFGKSVAVVAVNRNLTTPTSITNLNTSLPSGTYTDVLGGVLNGNNITSSGGNISSFTLAAGATAVWQYTASETTPTIGHVGPVMGKPGNVVTIDGRGFGSAKGTVYFGTTAVTGSAITSWEDTQIKVTIPPVAGGDYAVKVAANGVNSNAYNDFTILSGDQVSVRFVINNATTALGENIYLTGNVSELGNWTTGAASIGPAFNQVIHAYPTWYYDVSVPAGKQLEFKFFKKNGATITWEGGSNHTFTTPTSGTATVTINWQ

SEQ ID NO: 28559 - protein, 360 aa, Bacillus licheniformis
MVKVVKNFVKVNQYTRPGLKLAGVKGIVMHYTATPGASALNERDYFNGTCIAIKRKASSAHYFVDRKEAQHIIPENEVAYHAHDKNRCYVSFLKPNANTKSISVEMCVEKDGMIHSETVQNAAELVADLCKRYGLSTNKIVRHYDVTNKICPAPWVSDSSQLTTFRKKVDSLLGNKTVSKTTSSTSQSSKSTGTILKKGASGSQVKALQKRLIAAGFSLPKYGADGSYENETVQAVKALQKKAGIAVDGIYGPATEKALAAIGAKKKKPSSNGKKTSYPLPSGIYKVKSPLMKGTGVRQIQEALAALYFYPDKGAKNNGIDGYYGPKTANAVKRFQLMHGLSADGIYGSDTKAKLKTLLK

SEQ ID NO: 28560 - protein, 253 aa, Bacillus licheniformis
MVKIFIDPGHGGSDTGASANGLQEKQLTLQTALALRNMLLNEYQNVSVLLSRTSDQTVSLTQRTNAANSWGADYFLSIHMNAGGGTGFEDYIYPGVGAPTTTYRDIMHEEILKVVDFRDRGKKTANFHVLRETAMPALLTENGFVDNTNDAEKLKSSAFIQSIARGHANGLARAFNLSKNAAALYKVQIAAFRTKANADSLAAQAEAKGFDALVIYRDSLYKVQIGAFSSKENAEALVQQAKNAEFDTFIYQE

SEQ ID NO: 28561 - protein, 874 aa, Bacillus licheniformis
MAKTNSYKKVIAGTMTAAMVAGVVSPVAAAGKSFPDVPAGHWAEDSINYLVDKGAIVGKPDGTYGPTESIDRASAAVIFTKILNLPVDENAQPSFKDAKNLWSSKYIAAVEKAGVVKGDGKDNFYPEGKIDRASFASMLVGAYNLKEKVDGTLVTKFDDLRGHWGEEKANILVNLGISVGTGGKWEPNKSVSRAEAAQFIALTDKKYAKPENSDAKVTNVAATEPTQLTLTGTGLNKLTAEDVTLEGNKAIALEASKDGKSAVVTLSGKIAPNKELPVKVKGNTFIVKYVYEVKKLRVEQLTFDDDRADQAVVFKLNDEKGNADIEYLDIAGHDVKFVANNLDGTPANIFEGGTAESTTGKLAVGIAEGKYKVEVQVTKRGGITVSNTGIIEVKNLDAEATAIKDVVFAVDTDKAGVNYAKPLSGTDFTLNSKTLVAGEKAGIHKVVAQINKENKVVDPSAISLKSSNPGVISVKNGEIKAEAAGSATLTVKVGDVTKTFDFVVKTDTRKLTTVKANPDQLKVVDGKELPVTFVTTDQYGDPFGANSGAIKEVFPQTGVVKVLDVTTTNEGSIGTSSIKVKGENVGAGTIHFQNPNASGEGYGSLHVEVTKSNIGHEAPRLELVSKAGQKGEAADTTLGAGNTVAYQLSNYTTEGVYADAADLAGYEFRVGNDKIASAKIEGKTLKVTGKTAGVTDVILTKDGATAGHATITVTQENIQITSVKFKDVEVEQFENRKVNIDRVLDVVKSDKDDVLNGIKLNISTEHKVRIVDEGTEQGKVYLDRNDNATFDGNDVALGYVTAVKSNDTVSKEGNDLFKFLTDETATNKNDVFKGVTTAFGDKGTVIFKVMKDRVAPTTEYGTKAVTINVIKEEI

SEQ ID NO: 28562 - protein, 12 aa, Bacillus licheniformis
  MOD_RES (7)..(7): Any amino acid
ISLEICXIFHDN

SEQ ID NO: 28563 - protein, 74 aa, Bacillus licheniformis
MSKKEMILSWKNPMYRTESSYHPAGNILKELQEEEQHSIAGGTITLSTCAILSKPLGNNGYLCTVTKECMPSCN

SEQ ID NO: 28564 - protein, 72 aa, Bacillus licheniformis
MKTMKNSAAREAFKGANHPAGMVSEEELKALVGGNDVNPETTPATTSSWTCITAGVTVSASLCPTTKCTSRC

SEQ ID NO: 28565 - protein, 604 aa, Bacillus licheniformis
MNIVLVNKSKKFFVFSFIFVMLLSLSFVNGEVAKADSGKNYKIIGYYPSWGAYGRNFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPVARGNFAASAVEFLRKYGFDGVDLDWEYPVSGGLPGNSTRPEDKRNYTLLLQEVRKKLDAAEAKDGKEYLLTIASGASDRYVSNTELDKIAQTVDWINIMTYDFNGGWQSISAHNAALFYDPKAKEAGVPNAETYNIENTVKRYKEAGVKGDKLVLGTPFYEGAGAVVNPAATENIRSADRRKKGRGKMEYSTFQILKRTYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAASSGTNITEYVVSFESRSISVKETSAEIGNLNRGTAYSFTVSAKDADGELHTGPTVKVTTNSDQACSYDEWKETNAYTGGERVAFNGKVYEAKWWTKGDRRINPVNGAYGGWSEAANNRKSNG

SEQ ID NO: 28566 - protein, 598 aa, Bacillus licheniformis [sequence omitted]

SEQ ID NO: 28567 - protein, 296 aa, Bacillus licheniformis
QTLQTYNIENTVKRYKEAGVKGDKLVLGTPFYGRGWSGCEPGGHGEYQKCGPAKEGTWEKGVFDFSDLERNYVNQNGYKRYWNDQAKVPFLYNPENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE

SEQ ID NO: 28568 - protein, 592 aa, Bacillus licheniformis
MKIVLINKSKKFFVFSFIFVMMLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKANPGDVWDEPIRGNFKQLLKLKKSHPHLKTFISVGGWTWSNRFSDVAADPAARENSAASPVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRAGAVVNPGGTENIRNADRLKKGHGKRAYSIFQILKGTYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRLINPVNGAYGG

SEQ ID NO: 28569 - protein, 341 aa, Bacillus licheniformis
MKKLISIIFIFVLGVVGSLTAAVSAEAASALNSGKVNPLADFSLKGFAALNGGTTGGEGGQTVTVTTGDQLIAALKNKNANTPLKIYVNGTITTSNTSASKIDVKDVSNVSIVGSGTKGELKGIGIKIWRANNIIIRNLKIHEVASGDKDAIGIEGPSKNIWVDHNELYHSLNVDKDYYDGLFDVKRDAEYITFSWNYVHDGWKSMLMGSSDSDNYNRTITFHHNWFENLNSRVPSFRFGEGHIYNNYFNKIIDSGINSRMGARIRIENNLFENAKDPIVSWYSSSPGYWHVSNNKFVNSRGSMPTTSTTTYNPPYSYSLDNVDNVKSIVKQNAGVGKINP

SEQ ID NO: 28570 - protein, 354 aa, Bacillus licheniformis
MVKVINNFVKVNQYDRPGLKLAAVKGIVMHWTATPGASALNERNYFNGTCIADKRYASAHYFVDRHEAQHIIPDHEVAYHAHDQNRCYVSFLKPNANTTALGVEMCVEKDGTIHEETIRNAAELVADLCKTYGLSADRIVRHYDVTNKGCPTPWVRDAGQLSAFRKRVDSLLGRKTVSVSAASTSQTSSSSGIILKKGMSGSHVKKLQTRLVAAGFSLPKYGADGSYGDETVHAVVSLQKKAGIKADGIYGPSTEKALSAAEASAAGKSKTWTLPDGIYKVKNPLMKGTAVTQIQTALAALYYYPDKGAKNNGIDGYYGMKTANAVKRFQLMYGLGADGIYGPKTKAKMLSLLK

SEQ ID NO: 28571 - protein, 598 aa, Bacillus licheniformis [sequence omitted]

SEQ ID NO: 28572 - protein, 316 aa, Bacillus licheniformis
  strain DSM 13 / ATCC 14580
MVSKKSVKRGLITGLIGISIYSLGMHPAQAAPSPHTPVSSDPSYKAETSVTYDPNIKSDQYGLYSKAFTGTGKVNETKEKAEKKSPAKAPYSIKSVIGSDDRTRVTNTTAYPYRAIVHISSSIGSCTGWMIGPKTVATAGHCIYDTSSGSFAGTATVSPGRNGTSYPYGSVKSTRYFIPSGWRSGNTNYDYGAIELSEPIGNTVGYFGYSYTTSSLVGTTVTISGYPGDKTAGTQWQHSGPIAISETYKLQYAMDTYGGQSGSPVFEQSSSRTNCSGPCSLAVHTNGVYGGSSYNRGTRITKEVFDNLTNWKNSAQ

SEQ ID NO: 28573 - protein, 69 aa, Bacillus licheniformis
  strain DSM 13 / ATCC 14580
MKNSAAREAFKGANHPAGMVSEEELKALVGGNDVNPETTPATTSSWTCITAGVTVSASLCPTTKCTSRC

SEQ ID NO: 28574 - protein, 164 aa, Bacillus licheniformis
  strain DSM 13 / ATCC 14580
MFASSGSSTQESKSSGSSAKTTAAKTSEEKSNDDAKEKTEFGLNETADLDGTHITVTNVKKSMGNEYFKPNNGNEYVVATLNIENKSDKDISYNPLDFQIQNEDGQITHNTFGPSDDNDLSSGNLTPNGKVSGTITFETKKSKTYKVIYTPEFWNDKKITFNLK

SEQ ID NO: 28575 - protein, 341 aa, Bacillus licheniformis; identical to SEQ ID NO: 28569
  strain DSM 13 / ATCC 14580

SEQ ID NO: 28576 - protein, 74 aa, Bacillus licheniformis; identical to SEQ ID NO: 28563
  strain DSM 13 / ATCC 14580

SEQ ID NO: 28577 - protein, 86 aa, Bacillus licheniformis
  strain DSM 13 / ATCC 14580
MDMFFAYLLIASATPLFLWLDNKKVAISSIPPIILMWVFFFFYMTSSLSPTGHSLMIALFILNVVIAHVAAFIIYGLPLIRKHMSR

SEQ ID NO: 28578 - protein, 221 aa, Bacillus licheniformis
  strain DSM 13 / ATCC 14580
MKRLAGTVILSGLLVCGFGQALPEKALAAEVVHKTIVVEKGQTYDGKGKRLIAGPELGDGSQREDQKPIFKVEDGATLKNVVLGAPAADGVHTYGNASINNVVWEDVGEDALTVKSEGSVTINGGSARLAADKIFQINKASTFTVKNFTADQGGKFIRQLGGSTFKAVVNIDNCTITNMKEAIFRTDSSTSSVTMTNTRYSKVGQKWIGVKHATERNNHEF

SEQ ID NO: 28579 - protein, 430 aa, Bacillus licheniformis
  strain DSM 13 / ATCC 14580
MPYIVDVYAREVLDSRGNPTVEVEVYTESGAFGRALVPSGASTGEYEAVELRDGDKDRYLGKGVLTAVNNVNEIIAPELIGFDVTEQVSIDKLLIELDGTENKGKLGANAILGVSMAVARAAADFLQIPLYQYLGGFNSKTLPVPMMNIVNGGEHADNNVDIQEFMIMPVGAENFREALRMGAQIFHSLKSVLKEKGLNTAVGDEGGFAPNLGSNEEALQTIVEAIEKAGFKPGEEVKLAMDAASSEFYNKEDGKYHLAGEGVVKTSAEMVDWYEELTSKYPIISIEDGLDENDWEGHKLLTERLGSKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIQSFYNLNK

SEQ ID NO: 28580 - protein, 165 aa, Bacillus licheniformis
  strain DSM 13 / ATCC 14580
MMFASSGSSTQESKSSGSSAKTTAAKTSEEKSNDDAKEKTEFGLNETADLDGTHITVTNVKKSMGNEYFKPNNGNEYVVATLNIENKSDKDISYNPLDFQIQNEDGQITHNTFGPSDDNDLSSGNLTPNGKVSGTITFETKKSKTYKVIYTPEFWNDKKITFNLK

SEQ ID NO: 28581 - protein, 544 aa, Bacillus licheniformis
  strain DSM 13 / ATCC 14580
MAKDIKFSEEARRSMLRGVDALADAVKVTLGPKGRNVVLEKKFGSPLITNDGVTIAKEIELEDAFENMGAKLVAEVASKTNDVAGDGTTTATVLAQAMIREGLKNVTAGANPVGVRKGIEQAVAVAVESLKEISKPIEGKESIAQVASISAADEEVGSLIAEAMERVGNDGVITIEESKGFTTELEVVEGMQFDRGYASPYMVTDSDKMEAVLENPYILVTDKKITNIQEILPVLEQVVQQGKPLLLIAEDVEGEALATLVVNKLRGTFNAVAVKAPGFGDRRKAMLEDISILTGAEVITEDLGLDLKSTQINQLGRASKVVVTKENTTIVEGAGDTEQIAARVNQIRAQVEETTSEFDKEKLQERLAKLAGGVAVIKVGAATETELKERKLRIEDALNSTRAAVEEGIVSGGGTALVNVYNKVAALEAEGDELTGINIVLRALEEPIRQIAHNAGLEGSVIVERLKNEEIGVGYNAATGEWVNMIDKGIVDPTKVTRSALQNAASVAAMFLTTEAVVADKPEENKGGAGMPDMGGMGGMGGMM

SEQ ID NO: 28582 - protein, 1975 aa, Bacillus licheniformis
  strain DSM 13 / ATCC 14580
MRSKKYSFSLSKKRGLKSFLVTCLALYLIFSQVVGFTLTAVAAGTSTGGSVFFDSVTIKNSEDQTVDGSKGDEPALKPGDKVTLTYEWSLKNDEEAGAENSFTVEVPKSFEFAQDAEGEVKSADQQIIGSYQVKADSNIFTVTLKSPAEGSAGAKGAIALSAKFAADMKSDTKTVTALFQLGAGKTQQVIIPVNTGSESETAKNDPPSSEDDQSDDQSKSSGGQDQEETKKKAADAENSDSKPAASSRLAAAGSLASGGNQITQNILTGVTLTDEHGKPYDKSNRADTNSPAKISITWDIPNELGKTINDGDRYEFDLPEAFIMYNDITNQPLSSDGITYGYFSIDTKGHVVMTFNGEVKEDSNVKGTLFVNTQFNAQKIKGSTTQKIPFPVKSDTPEVTVYFKPKVSKTIDKSGTFDKGINPGQVTWTVDLNKKLDQVKNAKLQNFPEGLTYRSVKVYQLDVNIDGSVSRGDEVLSGYTVDADGNVTFDGEIDSAYRLIYVTDIDDSAKPNEGGNAAFRNKATFGGDNLEPASAEASVTAKYGKMIEKSSTGYKSDSQTFSWTILYNYGEKKIDESKASITDSFGSADLHLVSDSLKVIPITFNQNGSEQAGTPLTEGKDYTLSDNGSGFEIKFNQDVTGAYKITYQTEVNSGVIIDKSTTYTNTAVTGTGESKKASGTAVQQNLIKGYSNIDYKKKTVDWTIAINKNNYTMNNWKLDDNFESGGLTLLDGSFRLQDVTNNKTLEEGKDYTLIIKPDHEGFLLELIGDYATTNSQLKITYTTNMNADFSNENVKNTAESTWTDHSSTERKNKEASSFTPNRQTSHNGFKHGLYNAVSKEITWKIGINYNGEPSKNPYIKDSLADDQQFEKGSVVVKSYSVNKDGSITEGDILPASQYDVEEPSAANKQTLTVHLKTDDSVPYLIEFKTSLKGQVIKHDPYTNKATYHNAGYSERELTASVSVADGGSLVFKGGKQNGGYVDWSINVNASQSVLEDVKVTDTPDTNQILAEDSFKVYQAKYDEKGAVKDSSGNLVPDDVQLKKGEDYTLDIKTDNATGEQSFVLKFTGDYKKIDRAYVIQYQSLINIAGTSGHVNNKVSISGTNVQEQTQENNSSVFVAVSSGGGSGSGERGSLTILKTGEDGTPLSGADFQLRTKDNEQLLRTGTTDDNGKLTFGNIRYGTYILKEIKAPDGYTISDAYADGVSVEINSSSSSAGALYKVVNEKNKVTLIKQDEQKNPLEGAVFKLEKKSGDGAFTTIRTNIKSDKNGKVEINGLPPGDYRLLETKAPEGYLLNTKELGFSVKTNDKNQVPDVDLGTLINYKGRAHLTKEDAEGRQLEGAEFKLIDHEGKTIHEKLTSDQDGKTAVSDLAPGRYAFVETKAPEGYVINSKAIEFTISESAKEKPESVDAGKAVNYKGSVYLTKEDAEGRTLKGAEFKIVDHEGKTVHEKLTSDEDGKIAVSGLAPGRYAFVETKAPEGFMLNNDQIEFTIPGSAEGKPEPVDAGAAVNYKGSVHLTKEDAKGHKLEGAVFKIADQIGNTVQEELVSDRNGTVTASGLAPGRYAFVETKAPDGFVLNSGKIEFVIPDSAKGKPEHVDAGTFVNYKGSVYLEKKDEDGNGLEGAVFKIIDSEGKTVKDDLISKEGGKIEAGDLAPGSYQFVEKHAPDGYLLSTDPIPFSITGKHEGEPKQVKLTALNKKNSVVLTKVGQDDKSAGLQGAQFDLTDETGKVLKTGLATDADGRITVYGLKPGNYQFVETKAPKHYQLDKTPISFTVKNTDTKQIELTAENQLTPGDVKLTKVDSNNKKAVLKGAEFKLLDADGKPVKAGGNSKKLPAVWTTDQNGQFTAEGLAPGRYQFVETKAPDGYKLDETPIPFEIKKGQTKPVEVIASNEKLKTPAVDKGAPDPNSGDPKTDNKGTPDRNSKGDPKTNDNGHLKDTLPKTGDTDSIIPIMIGILLILSGGAFAFFTRKKQRKA

SEQ ID NO: 28583 - protein, 452 aa, Bacillus licheniformis
  strain DSM 13 / ATCC 14580
MKKKVYTFGLASILGTASLFTPFMNNTASAETSQQKQEIQQKRSEVNSGIESKRKEIAKLQDEQKKLEGKIQELDKKALETSNKIEDKEKENKKTKKEVEALKKEIKETEKRIEERSKVIKNRVRSLQENGGSQNYLNVLLGAQSFGDFITRATAVSTIVDADKDLLDEQEKDKNKLEKAMSDLNTKLDEIQKTLADLKTLKSDLDKQLKEQANLSKQLQTKQAAAESELSDLKKEAGSLTKEEAALEQKLKEERAAAAAAAKAKEESATAEKSDSGSSSSSNSGSVSKSDGSSNSGSSSSKKSSSPSRNYSSGSVVSSNGNAIEAAISTGSSIVGRSPYKWGGGRSQADIDNRRFDCSSFVRWAYASAGVELGFGATTSTLVGKGRAVSASEMKRGDLVFFDTYKTNGHVGIYLGNGTFLNDNSSRGVSVDSMSNPYWKKAFNGVVRRVVE

SEQ ID NO: 28584 - protein, 595 aa, Bacillus licheniformis
  strain DSM 13 / ATCC 14580
MLINKSKKFFVFSFIFVMMLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE

SEQ ID NO: 28585 - protein, 358 aa, Bacillus licheniformis
  strain DSM 13 / ATCC 14580
MRSKKFFLMMLLMIVAVVSTACGGSKSASGEKEDTKKADNAEVKILSSEYTLPDDSSTNLHENELILKINVSVKNTGKEPLMVDKSQFSLYEGDSKMSDVSVYDERNKRLRSSTLNSDKEVDGNIYYIVEKGKKFQLEYTPDMYGENKADPVKFEIDGGSDELLKTAKKLEDPAKALLAYTDVTIFGKDNNNFDKLVDENKREVVTDYLEGAQKSIVRSLGYYDEEDVDKKKLNKLISAIQNAYQEKSQVKAVTKSISGDEATVEATVTPIDNTDVQKKVKKRLEDYVKDSGKDFMSRDELINPAIDIMSEEIKKAEATSSEKTVEVKLEKSKNDKWKIDADNYKTEQYFSSFLKSNN

SEQ ID NO: 28586 - protein, 430 aa, Bacillus licheniformis WX-02; identical to SEQ ID NO: 28579

SEQ ID NO: 28587 - protein, 222 aa, Bacillus licheniformis WX-02
MMKRLAGTVILSGLLVCGFGQALPEKALAAEVVHKTIVVEKGQTYDGKGKRLIAGPELGDGSQREDQKPIFKVEDGATLKNVVLGAPAADGVHTYGNASINNVVWEDVGEDALTVKSEGSVTINGGSARLAADKIFQINKASTFTVKNFTADQGGKFIRQLGGSTFKAVVNIDNCTITNMKEAIFRTDSSTSSVTMINTRYSKVGQKWIGVKHVTERNNHEF

SEQ ID NO: 28588 - protein, 358 aa, Bacillus licheniformis WX-02; identical to SEQ ID NO: 28585

SEQ ID NO: 28589 - protein, 595 aa, Bacillus licheniformis WX-02; identical to SEQ ID NO: 28584

SEQ ID NO: 28590 - protein, 1975 aa, Bacillus licheniformis WX-02
MRSKKYSFSLSKKRGLKSFLVTCLALYLIFSQVVGFTLPAVAAGTSTGGSVFFDSVTIKNSEDQTVDGSKGDEPALKPGDKVTLTYEWSLKNDEEAGAENSFTVEVPKSFEFAQDAEGEVKSADQQIIGSYQVKADSNIFTVTLKSPAEGSAGAKGAIALSAKFAADMKSDTKTVTALFQLGAGKTQQVIIPVNTGSESETAKNDPPSSEDDQSDDQSKSSGGQDQEETKKKAADAENSDSKPAASSRLAAAGSLASGGNQITQNILTGVTLTDEHGKPYDKSNRADTNSPAKISITWDIPNELGKTINDGDRYEFDLPEAFIMYNDITNQPLSSDGITYGYFSIDTKGHVVMTFNGEVKEDSNVKGTLFVNTQFNAQKIKGSTTQKIPFPVKSDTPEVTVYFKPKVSKTIDKSGTFDKGINPGQVTWTVDLNKKLDQVKNAKLQNFPEGLTYRSVKVYQLDVNIDGSVSRGDEVLSGYTVDADGNVTFDGEIDSAYRLIYVTDIDDSAKPNEGGNAAFRNKATFGGDNLEPASAEASVTAKYGKMIEKSSTGYKSDSQTFSWTILYNYGEKKIDESKASITDSFGSADLHLVSDSLKVIPITFNQNGSEQAGTPLTEGKDYTLSDNGSGFEIKFNQDVTGAYKITYQTEVNSGVIIDKSTTYTNTAVTGTGESKKASGTAVQQNLIKGYSNIDYKKKTVDWTIAINKNNYTMNNWKLDDNFESGGLTLLDGSFRLQDVTNNKTLEEGKDYTLIIKPDHEGFLLELIGDYATTNSQLKITYTTNMNADFSNENVKNTAESTWTDHSSTERKNKEASSFTPNRQTSHNGFKHGLYNAVSKEITWKIGINYNGEPSKNPYIKDSLADDQQFEKGSVVVKSYSVNKDGSITEGDILPASQYDVEEPSAANKQTLTVHLKTDDSVPYLIEFKTSLKGQVIKHDPYTNKATYHNAGYSERELTASVSVADGGSLVFKGGKQNGGYVDWSINVNASQSVLEDVKVTDTPDTNQILAEDSFKVYQAKYDEKGAVKDSSGNLVPDDVQLKKGEDYTLDIKTDNATGEQSFVLKFTGDYKKIDRAYVIQYQSLINIAGTSGHVNNKVSISGTNVQEQTQENNSSVFVAVSSGGGSGSGERGSLTILKTGEDGTPLSGADFQLRTKDNEQLLRTGTTDDNGKLTFGNIRYGTYILKEIKAPDGYTISDAYADGVSVEINSSSSSAGALYKVVNEKNKVTLIKQDEQKNPLEGAVFKLEKKSGDGAFTTIRTNIKSDKNGKVEINGLPPGDYRLLETKAPEGYLLNTKELGFSVKTNDKNQVPDVDLGTLINYKGRAHLTKEDAEGRQLEGAEFKLIDHEGKTIHEKLTSDQDGKTAVSDLAPGRYAFVETKAPEGYVINSKAIEFTISESAKEKPESVDAGKAVNYKGSVYLTKEDAEGRTLKGAEFKIVDHEGKTVHEKLTSDEDGKIAVSGLAPGRYAFVETKAPEGFMLNNDQIEFTIPGSAEGKPEPVDAGAAVNYKGSVHLTKEDAKGHKLEGAVFKIADQIGNTVQEELVSDRNGTVTASGLAPGRYAFVETKAPDGFVLNSGKIEFVIPDSAKGKPEHVDAGTFVNYKGSVYLEKKDEDGNGLEGAVFKIIDSEGKTVKDDLISKEGGKIEAGDLAPGSYQFVEKHAPDGYLLSTDPIPFSITGKHEGEPKQVKLTALNKKNSVVLTKVGQDDKSAGLQGAQFDLTDETGKVLKTGLATDADGRITVYGLKPGNYQFVETKAPKHYQLDKTPISFTVKNTDTKQIELTAENQLTPGDVKLTKVDSNNKKAVLKGAEFKLLDADGKPVKAGGNSKKLPAVWTTDQNGQFTAEGLAPGRYQFVETKAPDGYKLDETPIPFEIKKGQTKPVEVIASNEKLKTPAVDKGAPDPNSGDPKTDNKGTPDRNSKGDPKTNDNGHLKDTLPKTGDTDSIIPIMIGILLILSGGAFAFFTRKKQRKA

SEQ ID NO: 28591 - protein, 165 aa, Bacillus licheniformis WX-02
MMFASSGSSTQESKSSGSSAKTTAAKTSEEKSNDDAKEKTEFGLNETADLDGTHITVTNVKKSMGNEYFKPKNGNEYVVATLNIENKSDKDISYNPLDFQIQNEDGQITHNTFGPSDDNDLSSGNLTPNGKVSGTITFETKKSKTYKVIYTPEFWNDKKITFNLK

SEQ ID NO: 28592 - protein, 732 aa, Bacillus macauensis ZFHKF-1
MNTVAGCVEISFLQSKRLSNLIFSLSNQIVTIFSNPTMEKRSFLSLTIYQLDALFCELNMRPAYQELVVISQTLSTFLNGSSFTPKGLGILLQSYLNKILQLIVLICDDCCSKAILISLIERSFLNLAIYDPPDPIMNVTGISVIGATGLTGATGATGPTGAAGLAGVQGETGATGPTGSTGATGATGVTGVTGETGSTGITGATGQTGITGSTGATGATGITGVTGETGSTGLPGVTGQTGITGSTGTTGATGVTGVTRETGSTGLPGVTGQTGITGSTGSTGATGATGVTGVTGETGSTGLPGVTGQTGITGSTGSTGATGPTGVTGETGSTGITGATGQTGITGSTGTTGATGATGITGVTGETGSTGITGATGATGQTGITGSTGTTGATGVTGVTGETGSTGLPGTTGPTGVSGVTGETGSTGVSGVTGQTGITGSTGTTGATGPTGVTGVTGETGSTGLPGVTGQTGITGSTGTTGATGPTGVTGVTGETGSTGLPGVTGQTGITGSTGTTGPTGATGVTGVTGSTGVTGSTGQTGITGSTGTTGTTGATGNTGVTGETGSTGLPGVTGQTGITGSTGATGATGATGSSVPALNSLYDNSANVSLSVPLSGETTIQTLNVPVVSGQRVKIDHTTQVAVTLGVLAWNFSYSLRIRRNGTLLNEVTITRGGSASGTIRFVTSNTYVDTVGATGTNAYTITIEYTTVLNVLSSAVEARNVNAVCFGSGT

SEQ ID NO: 28593 - protein, 359 aa, Bacillus macauensis ZFHKF-1
MKNTWKKVSAAMVTAGVLGSLVIPQQASAHGYVSKPASRSALCSSAFGSLNKECGGVAFEPQSLEAPKGFPAKGPADGKIASAGGLFGGILDQQTTNRWHKTTMTGGENTFTWSYTAAHNTSQWTYYITKKGWNPNQPLTRASFEKLTTIKHDGSAASTKLSHKVSLPKDRSGYYVILAVWDVADTSNAFYSTIDINLVNNGTLPPKTDEPHPPTKKPSSDQPTGVHSMKTTSSSVSLMWSGVKNADHYAIYRGTGAKLKKVSTTKDPAFLDKGLAAKTTYHYQIAAVSKAGKEGAKSSLFTVKTKEKVATHLKEWSAKAAYKKGDRVTYKGKTYEATKDYEGHGDSNWIHSSLWKVIA

SEQ ID NO: 28594 - protein, 377 aa, Bacillus macauensis ZFHKF-1
MSCICDFLFRLPLGSKFIVLLSTTSSLLRVTLTSLSPMTGCIQGVRENGTIATFNCCDVVSVFVGNFPSPICTNYIYVGNFGDNTVSVINGTTNEVIAVITVQEGPFNVKVQPRGQYVYISNFTSNTVSIINTRTLMVEETFVVDSPTAVVFSPDGLLAYISNGNSGTVTVIDTTTFQNVATIPVGSGVNSQPTALAITPSGDKILVTNQADGTVSVIDPATNTETTTITVGNIPQQVAITPNGAKAYVANNGDGTVSVIDVATNTVTSTISIGITSAPFGVTISPDGSLAYVVNESDNSVTIISTATDTIIGTITGGFDVPVEMAITPDGKLGYVTNSNGGTVSVVDLVSNTFIGNIPVGNTPFGIDLLTICTEPL

SEQ ID NO: 28595 - protein, 371 aa, Bacillus macauensis ZFHKF-1
MSNCMCSRLVHIIRGQIITLFLSSYATPLPIVFLSVDTTSGCIRGARIGSGSIVTVGCCDVAALYYGLYPLSNCSVLAFIADSGSSTVSVINTATNTVIATYTVETQPRSLVLSSDQSLLYVANLADNTISVVASTTGETITTITGITSPVDLALTPNNAYLYVANFLAETVTVVETATNTIVAVIPVSGIAGTIAISPNGSVAYVAGTNVNTIDVIDTSNNTVTATINVGGNPAGIVFSRDGTTAYVANRDDDSISVIDVLTNTVSATIANVSNPNYLALSPDGSRLYATDTTNGTVTVIDTVNNTQTAVIPTGGQLTTGIAITPDGRYAYVANALSSNVSVIDLRTNTVVAEVPVGSFPFGVTIGTFCS

SEQ ID NO: 28596 - protein, 430 aa, Bacillus macauensis ZFHKF-1
MSAIIEVYAREVLDSRGNPTVEVEVYTESGAFGRAIVPSGASTGEYEAVELRDGDKGRYLGKGVRTAVENVNALIAPELIGYDVLDQVGIDKTLIELDGTENKGKFGANAILGVSMAVARAAADLLGLPLYMYLGGFNAKTLPVPMMNILNGGEHADNNVDIQEFMVMPVGAPTFSEALRMGAEIFHSLKSVLKEKGLNTAVGDEGGFAPNLASNEEALQTIMEAIEKAGYKPGEEVRLAMDVASSELFNKEDGKYHLSGEGVVKTSEEMVAFYEDLVAKYPIVSIEDGLDENDWAGHKLLTERLGDKVQLVGDDLFVTNTVKLAQGIEQGVGNSILIKVNQIGTLTETFDAIEMAKRAGYTAVISHRSGESEDSTIADIAVATNAGQIKTGAPSRTDRVAKYNQLLRIEDELASIARYPGMSTFYNLQK

SEQ ID NO: 28597 - protein, 590 aa, Bacillus megaterium
MKRLFIAGMIFMLFFSLGAVSSSAAGSFTSKTYNGRTYKLYVPSSYQGGAALPLVVMLHGCTQDPDQFAAGTQMNALAETEKFLVLYPEQPSSANSNKCWNWFDTAHQSRGSGEPALIAGMVNQIKSSYSIDADQVFVGGLSAGAAMSVIMGATYPDIFAAISVGAGLEYKAATSVTGAYTAMSSGGPNPIQQGDLAYSAMGEHKRVVPVILFHGTADYTVAPINAHQILSQWAQTNDRASDGLDNNNIDDTADQTLPGTVSGGRSYTQYIYKDTAGKTVMEKYMIEGMGHAWPGGSTSGSYTDPKGPNATTLSWNFFKSHPKNSDAPNPGDISPPVTAASPAGGTYGSSVSVTLSTNEPATTYYTLDGSTPTVNSLKYSEPISINSSKTIKFFSVDAAGNQEGVKTEVYQISGTSEKSSVFSSLAAEDGFIGNLSADGMSSSIHKIGDKGMYNTDTYRTILSFDTSSLPDDAIITDVSLKIYRKSSTGNISSLKGDIKTGVFGTSSALEQIDYQASPSISAAFQMSVPSLDNGYTTIQLPSSLLGYMNRNGKTQFRLSSSGSADFLSDVVEIYGGDNPAYAPTLTVSYK

SEQ ID NO: 28598 - protein, 323 aa, Bacillus megaterium
MLGSLPNVINTSTLVSSSEQQEASSESFKTYTHKGKKFKVYLPKSYHILKSYPLMVMLHGCTQNADDFAIGTQMNELADEKEFIVVYPQQSSNSNMNKCWNWFEPLHQIRGFGEPAIIAGIVKKVQNMHFIQKNKVFIAGLSAGGAMSIVMGVTYPELFAGIGVSAGIEYQAALNVFNAYSVMASKGPSPVKQGRIAYQQMGKRAKPLPLIVFHGNADSTVNVANADQVVHQWITTNNLAYNGRIDGWIQGSPVKTREEKILFGRDYTTYRYESSKGELAIDKYIINGMGHAWSGGNSAGSYTDPKGPNASRIMWDFFMSQKV

SEQ ID NO: 28599 - protein, 562 aa, Bacillus megaterium
MKKKKQALKVLLSVGILSSSFAFAHTSSAAPNNVLSTEKYNKEIKSPEFISGKLSGPSSQKAQDVVFHYMNTNKDKYKLGNESAQNSFKVTEVVKDPVEQATVVRLQQVYNNIPVWGSTQLAHVAKDGTLKVVSGTVAPDLDKKEKLKGQKQVDSKKAIQAAEKDLGFKPTYEKSPSSELYVYQNASDTTYAYVVNLNFLSPEPGNYYYFVDAISGKVLDKYNTIDSVAGPKADVKQAAKPAAKPVTGTNTIGSGKGVLGDTKSLKTTLSSSTYYLQDNTRGATIYTYDAKNRTSLPGTLWADTDNTYNATRDAAAVDAHYYAGVTYDYYKNKFNRNSYDNAGRPLKSTVHYSSGYNNAFWNGSQMVYGDGDGTTFVPLSGGLDVIGHELTHALTERSSNLIYQYESGALNEAISDIFGTLVEYYDNRNPDWEIGEDIYTPGTSGDALRSMSNPAKYGDPDHYSKRYTGSSDNGGVHTNSGIINKAAYLLANGGTHYGVTVTGIGGDKLGKIYYRANTLYFTQSTTFSQARAGLVQAAADLYGSGSQEVISVGKSFDAVGVQ

SEQ ID NO: 28600 - protein, 802 aa, Bacillus megaterium
MKTKWLISVIILFVFIFPQNLVFAGEDKNEGVKVVRDNFGVPHLYAKNKKDLYEAYGYVMAKDRLFQLEMFRRGNEGTVSEIFGEDYLSKDEQSRRDGYSNKEIKKMIDGLDRQPKELIAKFAEGISRYVNEALKDPDDKLSKEFHEYQFLPQKWTSTDVVRVYMVSMTYFMDNHQELKNAEILAKLEHEYGTEVSRKMFDDLVWKNDPSAPTSIVSEGKPKRDSSSQSLQILSSAVIKASEKVGKERENFVQTSEELGLPLKIGSNAAIVGSEKSATGNALLFSGPQVGFVAPGFLYEVGLHAPGFDMEGSGFIGYPFIMFGANNHFALSATAGYGNVTDIFEEKLNAKNSSQYLYKGKWRDMEKRKESFTVKGDNGEKKTVEKIYYRTVHGPVISRDETNKVAYSKSWSFRGTEAQSMSAYMKANWAKNLKEFENAASEYTMSLNWYYADKKGDIAYYHVGRYPVRNSKIDERIPTPGTGEYEWKGFIPFKENPHVINPKNGYVVNWNNKPSKEWVNGEYSFYWGEDNRVQQYINGMEARGKVTLEDINEINYTASFAQLRANLFKQLLIDVLDKNKSTNGNYIYLIEKLEEWNNLKEDENKDGYYDAGIAAFFDEWWNNLHDKLFMDELGDFYGITKEITDHRYGASLAYKILNKESTNYKWVNVDQEKIIMESTNEVLAKLQSEKGLKAEKWRMPIKTMTFGEKSLIGIPHGYGSMTPIIEMNRGSENHYIEMTPTGPSGFNITPPGQIGFVKKDGTISDHYDDQLVMFAEWKFKPYLFNKKDINKAAKNVSALNMSK

SEQ ID NO: 28601 - protein, 322 aa, Bacillus megaterium
  strain ATCC 12872 / QMB1551
MNTLYSFFTNPVLTASTFLIELQSVFFQPIWKKYNYDDYFTYKVYVPSTYTGLSKVPLIVMLHGCQQDADDFAAGTEMNKLAEEKGFIVLYPQMNYFANSNGCWNWFYEYNQFRGNGEPDIIKDMIDHITAKYAIDSTNIYLAGMSAGGFMANVMAIAYPDVFKAVGIHSAGSNAYAVDLITAGEVMLYGSLNPELDGDEAYKKMGPYARPVPIITFHGQSDTTVNPINASTLIQQWIYTYKNFGINLHDNAAFYTSQDNGNHYSYIMSDYIDAENKIWMKKIMVEDMGHAWSGGNDNGSDTDSKGPNASKMMWDFFEAQND

SEQ ID NO: 28602 - protein, 184 aa, Bacillus megaterium
  strain ATCC 12872 / QMB1551
MSKKKWLIEASTCFLVLGLAACSSGESEKKSDDKELNVDAKFDKEKTDKFYNTVTKKLGETANVDDLAITVDSPQVVPDDELSKNKNGQFIKMNITIENKGKKNHKISELLHFNIQKGDTQYFATVVSGATENHLNGNISPGEKQSGIATFDISKEGDFKFEFSGFSKDRGIWTFTQEDIQPAQ

SEQ ID NO: 28603 - protein, 431 aa, Bacillus megaterium
  strain ATCC 12872 / QMB1551
MPAILDIYAREVLDSRGNPTVEVEVYTESGAFGRALVPSGASTGEYEAVELRDGDKSRYLGKGVLKAVENVNEIIAPELVGMDVTDQIGIDRLMIELDGTENKGKLGANAILGVSMAVAHAAADFVGLPLYRYLGGFNAKQLPTPMMNIINGGSHADNNVDFQEFMILPVGAPTFKEAIRMGAEVFHALKSVLSAKGLNTAVGDEGGFAPNLGSNREALEVIVEAITKAGYEAGKDIQLGMDVASSEFFNKETGKYDLAGEGRTGVTSAEMVDFYEQLVNEFPIVSIEDGLDENDWDGHKLLTERIGGKVQLVGDDLFVTNTKKLAQGIEQGVGNSILIKVNQIGTLTETFEAIEMAKRAGYTAVVSHRSGETEDATIADIAVATNAGQIKTGSMSRTDRIAKYNQLLRIEDELGVLAVYDGAKSFYNLKK

SEQ ID NO: 28604 - protein, 323 aa, Bacillus megaterium
  strain ATCC 12872 / QMB1551
MLGSLPNVINTSTLVSSSEQQEASSESFKTYTHKGKKFKVYLPKSYHILKSYPLMVMLHGCTQNADDFAIGTQMNELADEKEFIVVYPQQSSNSNMNKCWNWFEPLHQIRGFGEPAIIAGIVKKVQNMHFIQKNKVFIAGLSAGGAMSIVMGVTYPELFAGIGVSAGIEYQAALNVFNAYSVMASKGPSPVKQGRIAYQQMGKRAKPLPLIVFHGNADSTVNVANADQVVHQWITTNNLAYNGRIDGWIQDSPVKTKEEKILFGRDYTTYRYESSKGELAIDKYIINGMGHAWSGGNSAGSYTDPKGPNASRIMWDFFMSQKV

SEQ ID NO: 28605 - protein, 590 aa, Bacillus megaterium
  strain ATCC 12872 / QMB1551
MKRLFIAGMIFILFLSLGAVSSSAAGSFTSKTYNGRTYKLYVPSSYQRGAALPLVVMLHGCTQDPDQFAAGTQMNELAETEKFLVLYPEQPSSANSNKCWNWFDTAHQSRGSGEPALIAGMVNQIKSSYSIDADQVFVGGLSAGAAMSVIMGATYPDIFAAISVGAGLEYKAATNVTGAYTAMSSGGPNPIQQGDLAYSAMGDHKRVVPVILFHGTADYTVAPINAHQILSQWAQTNDRASDGLDNNNIDDTADQTATGTVSGGRSYTQYIYKDTAGKTVMEKYMIEGMGHAWSGGSTSGSYTDPKGPNATKLSWNFFKSHPKNGDAPNSGDISPPVTAASPAGGTYGSSVSVSLSTNEPAITYYTLDGSIPTVNSLKYSEPITINSSKTVKFFSVDAAGNQEEVKTEVYQISGTSEKPSVFSSLAAEDGFIGNLSADGMSSSIHKIGDKGMYNTDTYRTILSFDTSSLPDDAIITDVSLKIYRKSSTGNISSLKGDIKSGVFGASSALEQIDYQASPSISAGFQMSVPSLNNGYTTIQLPSSLWGYMNRTGKTQFRLSSSGPADFLSDVVEIYGGGSPAYAPTLTVSYQ

SEQ ID NO: 28606 - protein, 351 aa, Bacillus megaterium
  strain ATCC 12872 / QMB1551
MKKMNVLALAFVLMLVLAACNSSKETGGSTSAKNKAIEASIDSASYILVDSDEGATSEEKGLLKVDLKVKNVSKNSISLSDYDGVYLYEGDEQLSPKTGVNSRELGLESSASDKIGAGKQKNLTFVFEVKKDKKYKIGLQPKSSDYDEEIDEVTLTLDTKKYAKSYNKLQDPEKALQAYTEVLYLNKENVDYDKYVTADKTAVIEEQKKAFNEELKGAFSNSLTDKAKKDFFNMYKDVLKEKASVKTNVIANANNKAVVEVEYTTLDLSDLYSYVSQLKRAYTDETKDYDTQHSEEFAASKFKDIVNELETKEGSRPLRIFMVKEDGKWTVKSSDLYSDSLGKTFGSSYIR

SEQ ID NO: 28607 - protein, 438 aa, Bacillus megaterium
  strain ATCC 12872 / QMB1551
MAYKRATKVRYFSSNHDNNYLKKGNCKEKDCIDITGSQIRRLLTILDSLKDIIPLMLRNPNTGNINTLSNLMNRLITLLNELKPNSSAVTYLITTAQSLLSSLTTTLLPPMRLVSLLQKLINRLILLITLLCLNSETYILLLKNLNQLEAILAQYTSIGITGATGPTGATGIRGTPGPPGGPGVTGITGVTGPTGATGVTGDPGITGATGSTGATGITGAAGVTGVTGITGTTGVTGDPGIAGATGITGVTGVTGDPGIAGATGSTGATGITGATGVTGATGITGATGVTGATGITGATGTSLTTNSMFAGNTVGSTILVVLGGTSVPLPSNQNLDSFTVNGTNTTFTVPATGRYYITYQINTTAALLAGSRLILNGTTPIPGSTISPAVAASSYNNDVIVSLTVGDTITLQLFGLLATVVLTGGGSTGAALTIIRLS

SEQ ID NO: 28608 - protein, 590 aa, Bacillus megaterium
  strain DSM 319
MKRLFIAGIIFILFLSLGAVSSSAAGSFTSKTYNGRTYKLYVPSSYQGGAALPLVVMLHGCTQDPDQLAAGTQMNELAETEKFLVLYPEQPSSANSNKCWNWFDTAHQSRGSGEPALIAGMVNQIKSSYSIDADQVFVGGLSAGAAMSVIMGATYPDIFAAISVGAGLEYKAATNVTGAYTAMSSGGPNPIQQGDLAYSAMGDHKRVVPVILFHGTADYTVAPINAHQILSQWAQTNDRASDGLDNNNIDDTADQTATGTVSGGRSYTQYIYKDTAGKTVMEKYMIEGMGHAWSGGSTSGSYTDPKGPNATKLSWNFFKSHPKSGDAPNPGDVSPPVTAASPAGGTYGSSVSVTLSTNEPATTYYTLDGSIPTVNSLKYSEPITINSSKTVKFFSVDAAGNQEEVKTEVYQISGTSEKSSVFSSLAAEDGFIGNLSADGMSSSIHKIGDKGMYNTDTYRTILSFDTSSLPDDAVITDVSLKIYRKSSTGNISSLKGDIKSGVFGTSSALEQIDYQASPSISAGFQMSVPPLNNGYTTIQLPSSLWGYMNRTGKTQFRLSSSGPADFLSDVVEIYGGDNPACAPTLTVSYK

SEQ ID NO: 28609 - protein, 351 aa, Bacillus megaterium
  strain DSM 319
MKKMNVLALAFVLMLVLAACNNSKETGGSTSAKNKAIEASIDSASYILVDSDEGATSEEKGLLKVDLKVKNVSKNSISLSDYDGVYLYEGDEQLSPKTGVNSRELGLESSASDKIGAGKQKKLTFVFEVKKDKKYKIGLQPKSSDYDEEIDEVTLTLDTKKYAKSYNKLQDPEKALQAYTEVLYLNKENVDYDKYVTADKTAVIEEQKKAFNEELKGAFSNSLTDKAKKDFFNMYKDVLKEKASVKTNVIANANNKAVVEVEYTTLNLSDLYSYVSQLKRAYTDETKDYDTEHSEEFAASKFKDIVNELETKEGSRPLRIFMVKEDGKWTVKSSDLYSDSLGKTFGSSYIR

SEQ ID NO: 28610 - protein, 562 aa, Bacillus megaterium
  strain DSM 319
MKKKKQALKVLLSVGILSSSFAFAHTSSAAPNNVLSTEKYNKEIKSPEFISGKLSGPSSQKAQDVVFHYMNTNKDKYKLGNENAQNSFKVTEVVKDPVEQATVVRLQQVYNNIPVWGSTQLAHVAKDGTLKVVSGTVAPDLDKKEKLKGQKQVDSKKAIQAAEKDLGFKPTYEKSPSSELYVYQNGSDTTYAYVVNLNFLSPEPGNYYYFVDAISGKVLDKYNTIDSVAGPKADVKQAAKPAAKPVTGTNAIGSGKGVLGDTKSLKTTLSSSTYYLQDNTRGATIYTYDAKNRTSLPGTLWTDTDNTYNATRDAAAVDAHYYAGVTYDYYKNKFNRNSYDNAGAPLKSTVHYSSGYNNAFWNGSQMVYGDGDGTTFVPLSGGLDVIGHELTHAVTERSSNLIYQYESGALNEAISDIFGTLVEYYDNRNPDWEIGEDIYTPGTSGDALRSMSNPAKYGDPDHYSKRYTGSSDNGGVHTNSGIINKAAYLLANGGTHYGVTVTGIGGDKLGKIYYRANTLYFTQSTTFSQARAGLVQAAADLYGSGSQEVISVGKSFDAVGVQ

SEQ ID NO: 28611 - protein, 322 aa, Bacillus megaterium
  strain DSM 319
MNTLYSFFANPVLTASTFLIELQSVFFQPIWKEYNYDDYFTYKVYVPSTYTGLSKVPLIVMLHGCQQDADDFAAGTEMNKLAEEKGFIVLYPQMNYFANSNGCWNWFYEYNQFRGNGEPDIIKDMIDHITAKYAIDSTNIYLAGMSAGGFMANVMAIAYPDVFKAVGIHSAGSNAYAVDLITAGEVMLYGSLNPELDGDEAYKKMGPYARPVPIITFHGQSDTTVTPVNASTLIQQWIYTYKNFGINLHENAAFYTSQDNGNHYSYIMSDYIDAENKIWMKKIMVEDMGHAWSGGNNDGSDTDSKGPNASKMMWDFFEAQND

SEQ ID NO: 28612 - protein, 323 aa, Bacillus megaterium
  strain DSM 319
MLGSLPNVINTSTLVSSSEQQEASSESFKTYTHKGKKFKVYLPKSYHILKSYPLMVMLHGCTQNADDFAIGTQMNELADQKEFIVVYPQQSSNSNMNKCWNWFEPLHQIRGFGEPAIIAGIVKKVQNMHFIQKNKVFIAGLSAGGAMSIVMGVTYPELFAGIGVSAGIEYQAALNVFNAYSVMASKGPSPVKQGRIAYQQMGKRAKPLPLIVFHGNADSTVNVANADQVVHQWITTNNLAYNGRIDGWIQDSPVKTREEKILFGRDYTTYRYESSKGELAIDKYIINGMGHAWSGGNSAGSYTDPKGPNASRIMWDFFMSQKV

SEQ ID NO: 28613 - protein, 183 aa, Bacillus megaterium
  strain DSM 319
MKKFFKIGCLGFIILIALIVVIAVVASGGDDSGSGSSSNSSKSEEQKAHKVGDTFTVDNKAEVSVTKVEEREQVGNQYANKKASEGGTLVAIQWTVKNISDKPLGAFSTPTINLVDEKGTKYDADIDATSNYAVETNIDDSKIASDLNPGIKVTDVDVFEVSKDSYAKGTWYIEINGSKVQIK

SEQ ID NO: 28614 - protein, 431 aa, Bacillus megaterium; identical to SEQ ID NO: 28603
  strain DSM 319

SEQ ID NO: 28615 - protein, 275 aa, Bacillus megaterium WSH-002
MLGSLPNVINTSTLVSSSEQQEASSESFKTYTHKGKKFKVYLPKSYHILKSYPLMVMLHGCTQNADDFAIGTQMNELADEKEFIVVYPQQSSNSNMNKCWNWFEPLHQIRGFGEPAIIAGIVKKVQNMHFIQKNKVFIAGLSAGGAMSIVMGVTYPELFAGIGVSAGIEYQAALNVFNAYSVMASKGPSPVKQGRIAYQQMGKRAKPLPLIVFHGNADSTVNVANADQVVHQWITTNNLAYNGRIDGWIQDSPVKTREEKNSLWTGLYHISLRKQ

SEQ ID NO: 28616 - protein, 590 aa, Bacillus megaterium WSH-002
MKRLFVAGIIFMLFLSLGAVSSSAAGSFTSKTYNGRTYKLYVPSSYQGGGALPLVVMLHGCTQDPDQFAAGTQMNALAETEKFLVLYPEQPSSANSNKCWNWFDTAHQSRGSGEPALIVGMVNQIKSSYSIDADQVFVGGLSAGAAMSVIMGATYPDIFAAISVGAGLEYKAATSVTGAYTAMSSGGPNPIQQGDLAYLAMGEHKRVVPVILFHGTADYTVAPINAHQILSQWAQTNDRASDGLDNNNIDDTADQTVTGTVSGGRSYTQYIYKDTVGKTVMEKYMIEGMGHAWSGGSTSGSYTDPKGPNATKLSWNFFKSHPKNGDAPDPEDISPPFTAASPAGGTYGSSVSVTLSTNEPATTYYTLDGSIPTVNSLKYSEPITINSSRTIKFFSVDAAGNQEEVKTEVYQISGTSEKSSVFSSLAAEDGFIGNLSADGMSSSIHKIGDKGMYNIDTYRTILSFDTSSLPDDAIITDVSLKIYRKSLTGNVTFLKSDIKSGVFGTSSTLEQIDYQASPSISGGFQMSVPSLDNGYTTTQLPSSLWGYINKTGKTQFRLSNSGPADFLSDVVEIYGGDHSAYAPTLTVSYK

SEQ ID NO: 28617 - protein, 207 aa, Bacillus megaterium WSH-002
MKKIVTRSLVAAVLFTSLAACEDKQGDTHVTYKNPQPKHAPGADTISAADETMAPVSRVATEDETDDRLAFGERSKHGQYYVATTDAQFYPIKGAKQVNTQYVVVSVQFQRTPNEHSTVVLNDTTFTLQDTATYQTYEPSDGGNLSTETPHTVWTAFSSPSLSDDEPLNLDVAFKIPKKANHTYNLLITQQSERADVFKFEEAKQDY

SEQ ID NO: 28618 - protein, 351 aa, Bacillus megaterium WSH-002
MKKINVLALAFVLMLVLAACNSSKETGGSTSAKNKAIEASIDSASYILVDSDEGATSEEKGLLKVDLKVKNVSKNSISLSDYDGVYLYEGDEQLSPKTGVNSRELGLENSTSDKIGAGKQKNLTFVFEVKKDKKYKIGLQPTSSDYDEKIDEVTLTLDTKKYAKSYNKLQDPEKALQAYTEVLYLNKENVDYDKYVTADKTAVIEEQKKAFNEELKGAFSNSLTDKAKKDFFNMYKDVLKEKASVKTNVIANANNKAVVEVEYTTLNLSDLYSYVSQLKRAYTDETKDYDTEHSEEFAASKFKDIVNELETKDGSRPLRIFMVKEDGKWTVKSSDLYSDSLGKTFGSSYIR

SEQ ID NO: 28619 - protein, 322 aa, Bacillus megaterium WSH-002
MNTLCSFFTNPILTASTLLIELQSVFFQPIWKEYNYDDYFTYKVYVPSTYTGLSKVPLIVMLHGCQQDADDFATGTEMNKLAEEKGFIVLYPQMNYFANSNGCWNWFYEYNQFRGNGEPDIIKDMIDHITTKYAIDSTNIYLAGMSAGGFMANVMAIAYPDVFKAVGIHSAGSNAYAVDLITAGEVMLYGSLNPELDGDEAYKKMGPYARPVPIITFHGQSDTTVNPVNASTLIQQWIYTYKNFGINLHEKAAFYTSQDNGNHYSYIMSDYVDTENKTWMKKIMVEDMGHAWSGGNDNGSDTDSKGPNASKIMWDFFEAQKD

SEQ ID NO: 28620 - protein, 431 aa, Bacillus megaterium WSH-002; identical to SEQ ID NO: 666

SEQ ID NO: 28621 - protein, 432 aa, Bacillus methanolicus MGA3
MPFIADVYAREVLDSRGNPTIEVEVFTESGAFGRALVPSGASTGEYEAVELRDGDKGRYLGKGVLKAVDNVNEIIAPKLVGEEFNVLDQVSIDKALIELDGTENKSKLGANAILGVSMAVAHAAANYLDIPLYQYLGGFNAKQLPVPMMNILNGGAHADNNVDIQEFMVMPVGAESFKEALRMGAEIFHSLKAVLKAKGLNTAVGDEGGFAPNLKSNEEALQTIIEAIEKAGYKPGEQVMLAMDVASSELYNKEDGKYHLEGEGVVRTSEEMVAWYEELVSKYPIISIEDGLDENDWEGHKLLTERIGNKVQLVGDDLFVTNTKKLAEGIEKGVGNSILIKVNQIGTLTETFDAIEMAKRAGYTAVISHRSGETEDSTIADIAVATNAGQIKTGAPSRTDRVAKYNQLLRIEDQLGDTAQYLGIKSFYNLKK

SEQ ID NO: 28622 - protein, 484 aa, Bacillus methanolicus MGA3
MNKEVVVKSLKSIVYAGTLVIGISFFGNSVGAEGVNNQDVQAKSNVVTQPVVSNVQALTNAVVQPVVSNVQALTNAATQQVESNVQALTNAVNQPVESKEVTNTAIQSDENSQVKVTNTTSENNQEKATNTTSNEESIIPKNPPVKTGNPARKDENIKSEKKGSLINIGLGGSLLKPITGDLKIDIIGGKKVETKDGNSLITGGVVQADLKDSGLLGDTHLGVIEGTKIKTDDYEYTHGAVADLDIKKSVVGDAHVGVIEGEKVETDEYTWKHGGIAIIDTKNTPVLGDVHTGIGEIEDFETKQPAAPNQSEEPKDPKQPCNCNQGQPGNPGQPGSPGQPGTPGQPGNNPGQPGTPGQPGSPGQPGNLGQPGNPGQPGSPGQPGNPGQPGSPGQSGNPGQPGNPGQPGNPGQPGSPGQPGSPGQSGNPQQPERPSKQTPDIPDNNSEETLPKTGSVMDSSMLLLTSLMMILVGFVLRRFKSNLA

SEQ ID NO: 28623 - protein, 259 aa, Bacillus methanolicus PB1
MKQTLSILFLIILLAGCSSTKNNEANTGNEIQTENNVNEKNDETKQQKNQEQTENKIDNDQEYQPNPQVPDDRSLQKVGQTYEDEKGESTLKAIKSVNKTYEVGPIELTVKEMKLIHLRPDYSMIDYFHVLTHKEEFDFVKVFVEIKNTSSEKVNFAPIELLKTNTGETFDWEKDIYLEELHGEIEGNSTKAGNLGFIINAAGGQADKDEHDKGTDGHKSEDVHGNEAKDIKWIEIKTSDVFDKNKKKISESQKIKIEF

SEQ ID NO: 28624 - protein, 432 aa, Bacillus methanolicus PB1
MPIIADVYAREVLDSRGNPTVEVEVFTESGAFGRALVPSGASTGEYEAVELRDGDNGRYLGKGVLKAVENVNEIIAPKLVGEEFNVLDQVSIDKALIELDGTENKSKLGANAILGVSMAVAHAAANYLDIPLYQYLGGFNAKQLPVPMMNILNGGAHADNNVDIQEFMVMPVGAESFKEALRMGAEIFHSLKAVLKAKGLNTAVGDEGGFAPNLKSNEEALQTIIEAIEKADYKPGEQVMLAMDVASSELYNKEDGKYHLEGEGVVKTSEEMVAWYDELVSKYPIISIEDGLDENDWEGHKLLTERIGKKVQLVGDDLFVTNTKKLAQGIEKGVGNSILIKVNQIGTLTETFDAIEMAKRAGYTAVISHRSGETEDSTIADIAVATNAGQIKTGAPSRTDRVAKYNQLLRIEDQLADTAQYLGIKSFYNLKK

SEQ ID NO: 28625 - protein, 177 aa, Bacillus methanolicus PB1
MLTASIAYQIQSHLHEIFSTISGVATENGWKIQLKGNNYLYVIHEINEQKIVFSFSKNLSFEEYQQIHHIIISLQQHIKGTIDVSNSLLGYLPDGRGAYIITNWNKWSHFILTAKLKSLEGHKVIVYNGKGKELGNGLLLDYKLDKSPCVYECTLITTFGEQIFHGEYLVIEPTNKW

SEQ ID NO: 28626 - protein, 239 aa, Bacillus mycoides
MKGKLLKGVLSFGIGLGALYSGSSAQAEMSINQNNTLKVMTHNVYMLSTNLYPNWGQNERADLIGAADYMKNQDVVILNEVFDNNASNRLLGNLKKEYPNQTAVLGRSNGNEWDKTLGNYSSSTPEDGGVAIVSKWPIIEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYA

SEQ ID NO: 28627 - protein, 244 aa, Bacillus mycoides
MKSKLLKGVLSFGIGLGALYSGSSVQAETSTNQNNTLKVMTHNVYMLSTSLYPNWGQNERADLIGAADYMKNQDVVILNEVFDNNASNRLLGNLKKEYPNQTAVLGRSNGNEWDKTLGNYSSSTPEDGGVAIVSKWPIIEKIQYVFEKGCGPDNLSNKGFVYTKVKKNDRFVHVIGTHLQAEDNMCGQTSPASVRTKQLQEIQEFIKNKNISNNEYVLIGGDMNVNKINAENNSDSEYASMFKT

SEQ ID NO: 28628 - protein, 244 aa, Bacillus mycoides
MKGKLLKGVLSFGIGLGALYSGSSAQAEMSINQNNTLKVMTHNVYMLSTNLYPNWGQNERADLIGAADYMKNQDVVILNEVFDNNASNRLLGNLKKEYPNQTAVLGRSNGNEWDKTLGNYSSSTPEDGGVAIVSKWPIVEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKT

SEQ ID NO: 28629 - protein, 237 aa, Bacillus mycoides
NDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADD

SEQ ID NO: 28630 - protein, 949 aa, Bacillus mycoides DSM 2048
MALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLAQKEWSGYKTVTAYFVNYRVNSSNQFEYDVVFHGIAKDDGENKAPTVNVNGPYNGLVKEGIQFKSDGSNDEDGKIVSYLWDFGDGRTSKEVNPVHAYEREGTYKVALVVKDDKGKESRSETTVTIKDGSVTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGAYALSVK

SEQ ID NO: 28631 - protein, 333 aa, Bacillus mycoides DSM 2048
MKGKLLKGVLSFGIGLGALYSGSSAQAEMSINQNNTLKVMTHNVYMLSTNLYPNWGQNERADLIGAADYMKNQDVVILNEVFDNNASNRLLGNLKKEYPNQTAVLGRSNGNEWDKTLGNYSSSTPEDGGVAIVSKWPIVEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 28632 - protein, 182 aa, Bacillus mycoides DSM 2048; identical to SEQ ID NO: 28170

SEQ ID NO: 28633 - protein, 183 aa, Bacillus mycoides DSM 2048; identical to SEQ ID NO: 27302

SEQ ID NO: 28634 - protein, 503 aa, Bacillus mycoides DSM 2048; identical to SEQ ID NO: 27384

SEQ ID NO: 28635 - protein, 458 aa, Bacillus mycoides DSM 2048; identical to SEQ ID NO: 28199

SEQ ID NO: 28636 - protein, 455 aa, Bacillus mycoides DSM 2048
MNNRFLKQLQNLKMNKKSIGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVIFAVWDVADTANAFYNVIDVNLINNVKPDTEAPSIPNGIQAQKVTANSIELTWNVSTDNVGVKGYQIFRNGEMIDTVPGTYFIDKKLQPSTEYTYTVKAIDAAGNVSKESTALTVKTTVEALDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 28637 - protein, 738 aa, Bacillus mycoides DSM 2048; identical to SEQ ID NO: 27386

SEQ ID NO: 28638 - protein, 971 aa, Bacillus mycoides DSM 2048; identical to SEQ ID NO: 27385

SEQ ID NO: 28639 - protein, 118 aa, Bacillus mycoides DSM 2048; identical to SEQ ID NO: 26786

SEQ ID NO: 28640 - protein, 922 aa, Bacillus mycoides DSM 2048
MKERDRQNSLNSNFRISPNLIGPTFPPVPTGFTGIGITGPTGPQGPTGPQGPRGFQGPMGEKGPTGPQGVHGIQGPAGQMGATGPEGQQGPQGLRGPQGETGATGPQGVQGLQGPIGPTGATGAQGIQGIQGLQGPIGATGPEGPQGIQGVQGVPGATGSQGIQGAQGIQGPQGPSGNTGATGATGQGISGPTGITGPTGITGPSGGPPGPTGATGATGPGGGPSGSTGATGATGNTGVTGSAGVTGNTGPSGSTGETGAQGLQGIQGVQGPIGPTGPEGPQGIQGIPGPTGVTGEQGIQGVQGIQGITGATGDQGPQGIQGAIGPQGITGATGDQGPQGIQGVPGPTGDTGSQGVQGIQGPMGDIGPTGPEGPEGLQGPQGIQGVPGPAGATGPEGPQGIQGIQGPIGVTGPEGPQGIQGIQGIQGITGATGAQGATGVQGVQGNIGATGPEGPQGVQGTQGDIGPTGPMGPQGVQGIQGIQGPTGAQGVQGPQGIQGIQGPTGVTGDTGTTGVTGEGTTGATGVTGPTGVTGPSGGPAGPTGPTGPSGPTGVTGPSGGPPGPTGATGVTGGVGDTGATGATGVTGATGVTGATGATGLQGPQGIQGVQGDIGPTGPQGVQGPQGIQGITGATGDQGPQGIQGPQGIQGPTGPQGIQGGQGPQGIQGATGATGAQGPQGIQGIQGVQGPTGPQGPTGIQGVQGEIGPTGPQGVQGLQGPQGPTGDTGPTGPQGPQGIQGPTGVTGATGSQGIQGPTGATGATGSQGIQGPTGATGATGATGVTGVSTTATYSFANNTSGSAISVLLGGTNIPLPNNQNIGPGITVSGGNTVFTVTNAGNYYIAYTINLTAGLLVSSRITVNGSPLAGTINSPTVATGSFSAPIIANLPAGAAISLQLFGLLAVATLSTTTPGATLTIIRLS

SEQ ID NO: 28641 - protein, 154 aa, Bacillus mycoides DSM 2048
MALLTVGYSSVASASTGTLTKEESAQMQQDKAKKEEAIKEQQKSEVEKKEAAQVQEKSDMAKKEEAIKAGQKNDTAKQEVTPQVQEKEALAKKEAAIKAGQKNDAAKQEVAKQAVQGEKLPNTASNNVAMMALSACLVGIGTLFGLKRRNKVKA

SEQ ID NO: 28642 - protein, 431 aa, Bacillus mycoides DSM 2048; identical to SEQ ID NO: 26767

SEQ ID NO: 28643 - protein, 135 aa, Bacillus mycoides DSM 2048
MIDTKEVSVATNWKYTFEKLQVYDANGVAYKYEVKEQPVAGYKSEVNGYDITNTKIKDEPGVDPKDPSTDPKDPSTDPNTNTDKNSDSKVPPTTENDKPTLLPNTGGTSAETISILGGMVLFLLGGILFARQLIK

SEQ ID NO: 28644 - protein, 728 aa, Bacillus mycoides DSM 2048
MFATGITPSLEVFAEEQAQQKKVSTTLQNENSVNVENRVFAVPGKGDVSQLQNIERRERNFSAYEPTGLYAKPNEQITIQVQGNQSIQAYIGTFSFDASWREDSKIKSFTLNPGTNTIQSPNGGMIYFYNKQQGGTIQTTVITGGTATPLFELGKHTKQDLINMLNQYPNAHAVELKGERVLITASPVRVKKYLIDSNTDPVQLLKKMDEATRIQDKISGLSEEQVDKHYLHYVEDNHSLDYYMYAYPHRTAYVGDAIQHVLDINKFTNDGWGPWHEAGHMRQQTPWNFKNMTEVQVNLYSLAVEKAFTSNQPFRLQQEGAYTKAFQYLEQPNKNYDDISDLFVKVVMLWQLQLAYGEDFYPKLHQLYRDMPSNEIPQTDETKKQLFMISASKAAKQNLIPFFEKWGLRPNNDTIQKVAALGYPNLTAEIWKSTDSNPVKPDTPNFSNILEGNQFAWSMKGIGDFEFVKVNLNKSTEEMQINLKAGVPHNYFDSTYASIKVQNTSGKVVYNKEIYGNKQQNAEQAKVPVKVGNFIEFTHLEGANRATITNMEKNIQESFGNKAVYEITKEGLKKVDNIVNPKPDTEAPTQPQGLYASNVTSNSVELKWNSSTDNVGVKEYQVLRDGQLIQTVQGTTFTDQNLTANKEYKYAVKAVDAAGNTSIQSYILPIQTKDQNVSYEKWNPKKAYTKGDKVEHQGKVYEAVQNHQGNGDPNWIFALSLWKPLTIN

SEQ ID NO: 28645 - protein, 663 aa, Bacillus mycoides DSM 2048
MISQKTKKRFNKVIIITAACSMFSMFGTSISHTKAVTRSAAPSVYVSPQNTASSDIISIDWSPVQTAPYTYWAVHNWNAGGEAGGYAGFQQQSGFDENGKRTLHFALWDPIASKEAIKAEYLSPNSQAGLFGGEGTGLKVQTTYGWKDHNWYRMTMRSWQENGHTKFGQWMKDVTKNKWHLIAIMDFPVANVAFNHGLGMFQEDWAGNGQDVREARLKNGYSRKLLDKQWNSWNNQSISGQHDTSYQYDGGATSEYVWVKAGGNTQSTIGTGKIFTLNQPTQPEIGKLDFDIQSIYYENEKLNVSWKLKENSTPQFKGKIEIYNDENMTGQPIEIIDNIKSYQSEISQSILLSTNAYAKIILTDLFDQTVEKKVQIKNEFPNILEGNEFAWSLKGIGDFEFAKVNLNKSTEEMQIDLKAGVPHNYFDSTYASIKVQNTSGKVVYNKEIYGNKQQNAEQAKVPVKVGDFIEFTHLEGANRANITNMEKNMQESFGNKAVYEITKEGLKKVDSIVNPKPDTEAPTQPQGLYASNVTSNSVELKWNPSTDNVGVKEYQVLRDGQLIQTIQGTTFIDQNLTANKEYKYAVKAVDAAGNTSNQSNILLIKIKDQNISYEKWDPRKAYTKGDKVEHQGKVYEAVQNHQGNGDPNWIFALSLWKPLTLNF

SEQ ID NO: 28646 - protein, 762 aa, Bacillus mycoides DSM 2048
MQQSKVKNKKGGIILKRISSLLLTMPIILGSIATIPHTKVSAETMSFNQETFTLETLDQQTDQAIANGNFEAHLNNLTAYLNGNIGGITEENLKKKLVDPVFAAALAQWQFISQTGAATMDAFAKKDADHQKFLSWAMKNTDVMNTYLEGGSPTGKNPVNALEIWHTIWNADADSHKGLYLKLAISTSLAHAEPIKYWTSNKPINPLTRYQHYKSADQNNELLPCFRTYDVWHLRLVVNTWSPEEDLTWARNMINTEHPELKSQDKVGESAYLIKYTTHNKDGVSIHAGNDAFYGLGWNLSSIYRFGGVCGNISKFGTQVSQAFGVAAMPVGQPGHCALIWNNKPSSWNLGNDISGWGESSRHDATVIPWSDNSPTNQVPYMLLFENAERDPVKLDQSERLRWLAKAITSADNKIAIYKISTNILPINFLVWKDYVSLMLQNPNVTDAEWKELNNSIISVFANEPRPMMDLLTQIKSHVPNTDDILEGKQFSWSLKGIGDFEFAKVNLNKSTEEMQIDLKAGVPHHYFDGTYASIKVQNTSGKLVYNKEVYGNKQQNAESKTVPVKVGDFIELTHLEGEERATLINLDNNKHESFDKKVMYEVTKDGLKKVNQIVNPKPDTEAPTQPQGLYASNVTSNSVELKWNPSSDNVGVKEYQVLRDGQLIQTVQGTTFTDQNLKVSKEYKYAVKAVDAAGNTSNQSNILLIKTKDQNVSYEKWDPRKAYTKGDKVEHQGKVYEAVQNHQGNGDPNWIFALALWKPLT

SEQ ID NO: 28647 - protein, 959 aa, Bacillus mycoides DSM 2048
MMLGISTMALSFGSIQTQVSAEENTPYNVLQKKPIGIETSTDEIAHSTKADETLSYEERLKVGDFSQRPAPVVKRAAAKQFQQKYSVAELNRMSNDEFIDTLASISWNQITDLDQFNQETKEFYQNKERIQVIIDELGRRGSTFTKDDTKGIETFAEVLRSISYVGFNNKEVSYLNERSFHDKCLPALKAIAKNPNFKFGTDKQDAVVSAYGKLIRNASCDAETVQYAANILKQYNDNISTYISDKKKGDALFELIQGIDDDIQSYLFETRKKADETIWYGKIDGYINEVSRMALLNHLTTENKWLINNGIYYTGRLGNFHSNPNKPLEVLTQAMHMYPRLSEAYFNAVEQISTNYGGKDYNGNTVDFKKIREEGQQQYLPKTYTFDDGSIVFKTGDKVTEEKVKKLYWAAKEVKAQYHRVIGKDGALESGKADDVLTIVIYNNPDEYKRNSQLYGYDTNNGGIYIEGIGTFFTFERTPQQSRYSLEELFRHEFTHYLQGRYEVLGSWGQGEMYQDQRLTWFEEGNAEFFAGSTRTNNVVPRKSIISGLSSDPAKRYTAERTLFSKYGEGEGDEKWDFYNYSFALQSYLYTHQFETFDKIQDLIRANDVKNYDAYREALSKDPNLNKGYQDYMKQLIDNQGTYNTPQVSDDYLATPSLKPLADVKKDITDVAKIKDATITKHKSQFFDTFTLEGTYTGGVTKGESEDWKTMSKKINQSLEQLAQKEWSGYKTVTAYFVNYRVNAKNQFEYDVVFHGVATGEEEKQTVKVNMNGPYNEILNEKVEFHSDGTESTGGKIVSYLWNFGDGTTSTEANPTHVYGKEGTYTAKLTVKDNKGKVGRGQTSVTVKQDEPAGHNYQNAKVIRFNKLSKGNMDRPNLAYMHTFNVTSPKEVDISFIDEQGIGIQWDVYHESDLEHPVITGQADGNNIKGKFEAKPGKYYLVSFFEKENGKGTYSLVVK

SEQ ID NO: 28648 - protein, 209 aa, Bacillus mycoides DSM 2048; identical to SEQ ID NO: 28452

SEQ ID NO: 28649 - protein, 916 aa, Bacillus mycoides DSM 2048
MMKNKKRTATVALTTGLALTAVIPYGVGHAEETDQLQVQIQEDSFRTGELTQPSQKAPENVVKDALKEKTEQALSPKQVNGEMGVDYKVLQKRGSYDGTTLVRMQQTYEGKEVYGYQLTAHVDKKGVIKSVSGDSAQNLKQEDLKKPINLSQEKAKQYIFTKYGNDIKFISEPEVKKVIFVDENNGQASNAYQVTFAAVTPKYVSGTYLVNAHNGEMLKNMVQDSDLKASEKLVDALEESRKSNLASLTGTGNDAFGISRTFGISKQSNGEYALADYSRGQGIETYDVNYRDITKEESYYPGTLATSTSTTFNDPKAVSAHYLATKVFDFYKDKYKRNSFDNKGQKVVSVVHAWDSEDTNDPKNWKNALSANINNSSMLVYGDPMVKAFDVAGHEFTHAVTSSESNLEYSGESGAINEALSDIMGTAIEKYINNGNFNWTIGEQTGLVLRDMKNPSSINYSNGVPYPDDYSKYTNLNGEDDGGVHFNSSIINKVAYLIAKGGTHNGVTVKGIGEDKMFDIFYYANTDELNMTSDFFELRSACLRVATNKYGANSAEAQAVQKAFDAAKIKVTVEEKEKAVEKQAPELTVPFTTTLHVGDTFDPMRGVKAVDKEDGDLTNRVKHKGDVDTSKPGNYIVEYSVVDSQGVNATATQTVIVEENGETPDMEPKLTVPVGATINVGDSFDPMARVSATNKEDGDLTSKVTVDGKVDTSKAGTYVLTYTVTDTKGHEVTAKQIVTVKAGEEVKDEKPVLKVPAETTIIEGNQFASMAGVSATDKEGGDLTSKVTHEGTVDTSKAGTYEVIYSVKDSAGNKVTTIQKVVVKDKDNGNGSNNRNNGSDNDNGSDNVSTGTNNSNASDTGNSNISNNSTTDKKEDTYKELPKTGASTNNSAAMGVLMVLAGMVLSFGRKFRKVLK

SEQ ID NO: 28650 - protein, 305 aa, Bacillus mycoides DSM 2048
MQSTTAFSLAAAPNYKKGQVVTYTSSGYVVKKDAPQGFPNVSQDYIVLVEGGPTGSTGTTGSTGATGSTGATGATGTTGATGSTGSTGSTGATGTTGVTGSTGATGSTGVTGSTGATGTTGVTGSTGATGTIGATGSTGTTGPAGSSTAKSIVFQGTNAGFQRIAGSPGIDSNVIPYVTAGAGNIVGFATSININNLPAAVYTIDICRNVPTNLSAPTSSYILSTITLTTTDKITGTMTFSIKPTDIGSRQPQVYNPTPAPGPATVTWTSITTGNLFSRGDAISLYITPGITASSVYSIFLITDI

SEQ ID NO: 28651 - protein, 971 aa, Bacillus mycoides Rock1-4
MDFINGGNVMNKKSKFTQMMLGISTVALSFGSIQTQVSAEENTPYNVLQKKPIGIETSTDEIAHSTKADETLSYEERLKVNDFSQRPAPVVKRAAAKQFQQKYSVAELNRMSDDELIDTLANVSWDQITDLSQFNQETKAFYQNKGRIQVIIDELGRRGSAFTKDDTKGIETFVEVLYCGFYLGFNNKELNYLNERSFHDKCLPALKAIAKNPNFKLGTNKQDKVVSAYGKLIRNASCDAETVQYAGNILKQYNDNISTYVSDKNKGDALYNLIQGIDEDIQSYLNGTRKKADETIWYGKIDGFINEVSRMALLNQVTTENSWLINNGIYYAGRLGEFHSNPNKPLEVLTQAMHMYPRLSEAYFNAVEQISTNYGGKDYNGNTVDLKKIREEGQQQYLPKTYTFDDGSIVFKTGDKVTEEKVKRLYWAAKEVKAQYHRVIGNDAALESGKADDVLTIVIYNDPYEYKRNSQLYGYDTNNGGIYIEGKGTFFTFERTPQQSSYTLEELFRHEFTHYLQARYEVPGAWGQGELYQNERMTWFDEGNAEFFAGSTRTNNVVPRKSVIKGLSSNPAERYTAERTLFSKYGSWDFYNYSFALQSYLYTHQFETFDKIQDLIRANDVKGYDAYREALSKDPNLNKEYQDYMKQLIDNQDKYNTPQVSDDYLAEHAPKPLADVKKEIVDVAKIKDATMTKHNSQFFNTFTLEGTYTGGVTKGESEDWKAMSKQINQSLEQLAQKEWSGYKTVTAYFVNYRVNANNQFEYDVVFHGVATGEEEKQTIKVNMNGPYNEMLNEKVEFHSDGTESTGGNIVSYLWDFGDGTTSTEANPTHVYGKEGTYTAKLTVKDNKGKVGRGQTTVTVKKDEPVGHGFDSAKAIRFNKLFKGNMDMPNMAYMYTFNVTSPKEVDISFIDEQGIGIKWDVYHESDLGNPVITGQADGNNMKGKFEAKPGKYYVVAFFEEENRKGTYSLLVK

SEQ ID NO: 28652 - protein, 497 aa, Bacillus mycoides Rock1-4
MVAIATAIPLVLGTVSVVSAVEEKQVKIDRYSPQEKAAEYLKANAAQYSLKTDLSDLQYISTTDTQVASYVRFQQVVNGSPVFSKQITVTLNGKGQGVLAVSDYQPVQNVKEIKQKISEKDAEQKSKVYVGGESEQNLWAPTMKEFGYIIEEGVAIPVYRVVVHSNQPFGAWETFIDAENGKLLKKVDINRKAEGTGKVFLPNPVVTSGSVTGLKDNNDADSAALNNQLKTVTLKGLNGTGFLVGDYVTISSKAKTKSSTLQFNYTRSNDSFEDVMAYYHIDTLQRYIQQIGFKNINNRSIKVNVNGTRDDNSFYSPSTKDLTFGTGGVDDAEDAGIIAHEYGHSIQDNQVPGFGSSPEGGAMGEGFGDFLGATYEDATSTTGYGKACVGEWDATSYSSSNPTCLRRLDNNKVYPRDVQNEVHADGEIWSQGEYEMAQSFGRDVATKIILQSHWSLTPNAKFRDGAKAIKQADALLYGGQHAAEIDRIWAARGISTN

SEQ ID NO: 28653 - protein, 198 aa, Bacillus mycoides Rock1-4
MGGALVFNLSGCGSTSDKTSSESKETTSKQEEKNVKTNDTTKGNTDSKNTEQTKEKTKIKEKEYSLNKTFNTPKFDVTVKRVVERDKVGKESIGIQEPENGHVFIVIEVEGKNITNEPMKLAVLPSVDLVDENDNAYQSDVWATSSYEVEKGETSTISKELKPGDVKSGNKVYVINKEKFDTGKWYVLVNHEHKEQIK

SEQ ID NO: 28654 - protein, 169 aa, Bacillus mycoides Rock1-4
MLKKKTVQFFENLNLNGGSKKPLSNLVEAHEWGSKHFDSWIESLTESERSAIRQYTGDDYRKINNYLRGIADSLDGVESSVIDNIKSGLNKASVPYDIQVYRGTDLKSFENLMSRFFYFKKKSALILLSLLQWTKRFQCCHIFYIKSIFSKKVYMLPAQVVKYVLAIPH

SEQ ID NO: 28655 - protein, 868 aa, Bacillus mycoides Rock1-4
MLGVGLVTISCNGLQVQAETKEKYTKNTLQMEPIGLRQSPDELAHSSNIQESTSFTKRLKLADLSQRPPMPKENTKQLVEERKYSMAELNQLSNKQLADLLVTIKWNQIPELFQFNNDSLKFYQDNSRMQALIDKLAEQGQTYTKDDSKGVETLVEVIRSGFYLGFYHQELSKLSERSYHDKCLPALKTIAKNPNFKLGTSEQNKVISSYGMLIGGASADVEIIQYAAGILKQYNDNFSTFIEDRTKGDAIYNLMKEIDYDVQSYMYTTDKEPKDTMWYKNIDSFINEVSRFALIGTVTDKNGWLINNGIYYASRFGKFHSTPTKGQQVVTEAMRIYPYLGQQYFVAAEQITTNYGGVDANGKTINLDKIREDGKQKYLPKTYTFDDGAIVFKAGDKVTEEKIKRLYWAAKEVKAQFYRTVGSNKPLESGHADDVLTMVIYNSPDEYQFNRQLYGYETNNGGIYIEGIGTFFTYERTPQQSIYSLEELFRHEFTHYLQGRYEVPGLWGQGELYQNERLTWFEEGNAEFFAGSTRVDSVVPRKSIIGGLSNDPAKRYTAEQTLNAKYGAWDFYNYSFALQSYMYNNRPDMFDKVHDLIRANDVPGYDVYRSALSKDNKLNEDYQSYMQMLINNRDKYTIPQVSDDYLARHKLKALSNVAADITNEAKLKNVKVTKNKSQFFNTFTLQGTYTGSTSKGENEDWKAMNQATNEMLKHLSQKEWSGYKTLTAYFVNYRVNAAGQFEYDIVFNGVNTEEDTSVEKEPNNSFDTANPLSLNTLLRGSLNNQDQVDRFVIDIREAKGLQITVTNEQNLGLNWVLYQESDLNNYVTYATKYEGNKLLGSYYANLGKYYLSVYKYGSGTGNYTIEVK

SEQ ID NO: 28656 - protein, 134 aa, Bacillus mycoides Rock1-4
MKKKLLPICAMALLSVGYSSVASASTGTMTKEEVAQVQQDTTKKEAAMQEQQKQDKMKKEAAVQEQQKQDKMKKEAVVQEQQKQDQMKKEAAVQATKGEKLPNTASNSITMMTLSACLVALGSLFGFTRRKIKA

SEQ ID NO: 28657 - protein, 430 aa, Bacillus mycoides Rock1-4
MSTIIDVYAREVLDSRGNPTVEVEVYTESGAFGRAIVPSGASTGEHEAVELRDGDKSRYLGKGVVNAVNNVNEIIAPEIVGFDVTDQAGIDNAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLTGEGRSMTSAEMVDFYEGLCNDFPIISIEDGLDENDWDGHKLLTDRLGKKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGLKSFYNLKK

SEQ ID NO: 28658 - protein, 351 aa, Bacillus mycoides Rock1-4
MKIKQFMSVCFAAILTVGFVSGCDSSKSSTEVKENKVYGVGDTGKTQNIELKLESAEFVLPGQFAKQTNDRVLKVKVSLKNKGDKVIKMLPQDFSLYQKDEKTNLYYTSDPNELKGGDVDNGKKVSGTIYYNVKDSSSYELVYKKYIMDPKKEKEEKISFKIQGKELAEKAKELQRPAEALTAYLNAAFYDKDSNKINDLSGEDGTAFVKEVESSFKRTNERMFNNQIDEQGMLNYYKTLKTAFQKNVKFETKVVSLDGDRAQVELKAKPIMLNELKSRFQSEAMTIANQNPNITKEELTKKLFDYAVQLIPEARPGDTEETVKITMLKHGKNQWRLDTASADQIMKVFIK

SEQ ID NO: 28659 - protein, 713 aa, Bacillus mycoides Rock1-4
MKKLKPALSVLGSVTMALTIASPALADVKQPNAGSTVEIFKEDANAKEGKVIYGTDGKKGKMSTEKIEVQNNDWDKDGISNDLEIHGYKIEFNGQTGKNEARAWNPETDKNKLKFITNPMMGNSDGDAFSDAYEVQHYGNNSDTEFNPMVANMPNLQIGVKRIKITPVASITDSNGGSINQGWEKSVSTQHSFGIGAGVEGGAEGSAAGPVPSGKASVNVSYGYSKTSTDTERYSSNLDWSTAKTVDSAKAAQVSIQLEYKNTGTASAQNVSPHFNIRLGEDIIHTSKGTQERYKANQLSTEKGGRNTTEVLVDSVENNPDVKIYLSLDQLKAVEQGAPLSVEVLPTSTMDLYMQEDGKYITLGDSGKYESDVNSATALLETDIGNKPKFRMYAPEGVGSDTNLTFNEVLKHVKVDSAKINEFIDNSNGEQAIIAKDNLENAKKSYVSKKAKVGVFTKIQQPELSHSAYNPFTKKFYASVVPGLFGASNEISASFENKKSKQTQQVTLVKKGNVYESKETVSLNDFNPTQKVTFEINDAQKKLPTQKISTVVTYDQEYDNYVTEKGSDALVVEGTPYTMKSNGYAVQSYKGSNNWQYLAVAGNYLKPVNLIIERKGQPKPGQPIKTGEEVHIKVQNSAYSGYEYLKLQDGYIHFDQKQNASTFKIDHLYGKDDRFYKSAWKLQSDGNDIGLPYNGYVSYGNKNFNSWTFEKAK

SEQ ID NO: 28660 - protein, 87 aa, Bacillus mycoides Rock1-4
MNRQEEPITLNSKNFKLIDDLGREYYSSTEAQLALKAVNNAIFKIDTLNPDSSSSGKIVFDVPKYAKGLVLQFNGDMLDKEIDLKVE

SEQ ID NO: 28661 - protein, 53 aa, Bacillus mycoides Rock1-4
MINQDTQLNFGKLAQNGKITGTIAFESKQGDPKLQLIFKPISLSEEEVRVNLQ

SEQ ID NO: 28662 - protein, 204 aa, Bacillus mycoides Rock1-4
MGNNHFHNVFAVKQEHFGQVLKLKKFFEELDMDFNDFTDPRTLVNVLESNRDINFLKSSQEAIIGGEALRISELIEKISNLIIKDILAFPTYRWGESINQDIVSQVTDAITNMFINLNKQDAEPWIFWYNTGSVFPRYTYNILIAIDTQDKDYLTDVLAISFDVLVVKKTKQEVCSFTVNDSAQCLIMMKHMLVGIKFEDVYPS

SEQ ID NO: 28663 - protein, 497 aa, Bacillus mycoides Rock3-17; identical to SEQ ID NO: 28652

SEQ ID NO: 28664 - protein, 198 aa, Bacillus mycoides Rock3-17; identical to SEQ ID NO: 28653

SEQ ID NO: 28665 - protein, 262 aa, Bacillus mycoides Rock3-17
MQDGKNIRLDRVRLESLKAEKYGNEKMYQLGGRMAEGVDYIGKSIGKVPAENGNVLKTKTVQSFENLNLNGEAKKPLSNLEEAHEWGSKHFDNWIESLTESERSAIRQYTGDDYRKINNYLRGIADSLNDVESSVIDNIKSGLNKASVPYDIQVYRGTDLKPFKNLYKIDDEGKIVVDSLVGKTVKDNGFVSTAMVKESSFDHMNVSWEINVPKGANAAYVGKISYIPTEAELLFNSGQEMVIKSANVDSDGKIHLILDLIK

SEQ ID NO: 28666 - protein, 878 aa, Bacillus mycoides Rock3-17
MVKYSKFYKLMLGVGLVTISCNGLQVQAETKEKYTKNTLQMEPIGLRQSPDELAHSSNIQESTSFTKRLKLADLSQRPPMPKENTKQLVEERKYSMAELNQLSNKQLADLLVTIKWNQIPELFQFNNDSLKFYQDNSRMQALIDKLAEQGQTYTKDDSKGVETLVEVIRSGFYLGFYHQELSKLSERSYHDKCLPALKTIAKNPNFKLGTSEQNKVISSYGMLIGGASADVEIIQYAAGILKQYNDNFSTFIEDRTKGDAIYNLMKEIDYDVQSYMYTTDKEPKDTMWYKNIDSFINEVSRFALIGTVTDKNGWLINNGIYYASRFGKFHSTPTKGQQVVTEAMRIYPYLGQQYFVAAEQITTNYGGVDANGKTINLDKIREDGKQKYLPKTYTFDDGAIVFKAGDKVTEEKIKRLYWAAKEVKAQFYRTVGSNKPLESGHADDVLTMVIYNSPDEYQFNRQLYGYETNNGGIYIEGIGTFFTYERTPQQSIYSLEELFRHEFTHYLQGRYEVPGLWGQGELYQNERLTWFEEGNAEFFAGSTRVDSVVPRKSIIGGLSNDPAKRYTAEQTLNAKYGAWDFYNYSFALQSYMYNNRPDMFDKVHDLIRANDVPGYDVYRSALSKDNKLNEDYQSYMQMLINNRDKYTIPQVSDDYLARHKLKALSNVAADITNEAKLKNVKVTKNKSQFFNTFTLQGTYTGSTSKGENEDWKAMNQATNEMLKHLSQKEWSGYKTLTAYFVNYRVNAAGQFEYDIVFNGVNTEEDTSVEKEPNNSFDTANPLSLNTLLRGSLNNQDQVDRFVIDIREAKGLQITVTNEQNLGLNWVLYQESDLNNYVTYATKYEGNKLLGSYYANLGKYYLSVYKYGSGTGNYTIEVK

SEQ ID NO: 28667 - protein, 134 aa, Bacillus mycoides Rock3-17; identical to SEQ ID NO: 28656

SEQ ID NO: 28668 - protein, 430 aa, Bacillus mycoides Rock3-17; identical to SEQ ID NO: 28657

SEQ ID NO: 28669 - protein, 713 aa, Bacillus mycoides Rock3-17; identical to SEQ ID NO: 28659

SEQ ID NO: 28670 - protein, 351 aa, Bacillus mycoides Rock3-17; identical to SEQ ID NO: 28658

SEQ ID NO: 28671 - protein, 182 aa, Bacillus mycoides Rock3-17
MNRKLLISLSCSTLLFGLSACSSHDKTNSDTKTQQEDTKEIKKDEPRKKEPQKELSNKGESANVYIMVSYAESLDVIGNEDVKAQGIFKALEVYVMNRQEEPITLNSKNFKLIDDLGREYYSSTEAQLALKAVNNATFKFDTLNPDSSSLGKIVFDVPKYAKGLVLQFNGDMLDKEIDLKVE

SEQ ID NO: 28672 - protein, 971 aa, Bacillus mycoides Rock3-17
MDFINGGNVMNKKSKFTQMMLGISTVALSFGSIQTQVSAEENTPYNVLQKKPIGIETSTDEIAHSTKADETLSYEERLKVNDFSQRPAPAVKQAETKQYQQKYSVAELNRMSDDELIDTLANVSWDQITDLSQFNQETKAFYQNKGRIQVIIDELGRRGSAFTKDDTKGIETFVEVLYCGFYLGFNNKELNYLNERSFHDKCLPALKAIAKNPNFKLGTNKQDKVVSAYGKLIRNASCDAETVQYAGNILKQYNDNISTYVSDKNKGDALYNLIQGIDEDIQSYLNGTRKKADETIWYGKIDGFINEVSRMALLNQVTTENSWLINNGIYYAGRLGKFHSNPNKPLEVLTQAMHMYPRLSEAYFNAVEQISTNYGGKDYNGNTVDLKKIREEGQQQYLPKTYTFDDGSIVFKTGDKVTEEKVKRLYWAAKEVKAQYHRVIGNDAALESGKADDVLTIVIYNDPYEYKRNSQLYGYDTNNGGIYIEGKGTFFTFERTPQQSSYTLEELFRHEFTHYLQARYEVPGAWGQGELYQNERMTWFDEGNAEFFAGSTRTNNVVPRKSVIKGLSSNPAERYTAERTLFSKYGSWDFYNYSFALQSYLYTHQFETFDKIQDLIRANDVKGYDAYREALSKDPNLNKEYQDYMKQLIDNQDKYNTPQVSDDYLAEHAPKPLADVKKEIVDVAKIKDATMTKHNSQFFNTFTLEGTYTGGVTKGESEDWKAMSKQINQSLEQLAQKEWSGYKTVTAYFVNYRVNANNQFEYDVVFHGVATGEEEKQTIKVNMNGPYNEMLNEKVEFHSDGTESTGGNIVSYLWDFGDGTTSTEANPTHVYGKEGTYTAKLTVKDNKGKVGRGQTTVTVKKDEPVGHGFDSAKAIRFNKLFKGNMDMPNMAYMYTFNVTSPKEVDISFIDEQGIGIKWDVYHESDLGNPVITGQADGNNMKGKFEAKPGKYYVVAFFEEENRKGTYSLLVK

SEQ ID NO: 28673 - protein, 204 aa, Bacillus mycoides Rock3-17; identical to SEQ ID NO: 28662

SEQ ID NO: 28674 - protein, 175 aa, Bacillus mycoides Rock3-17
MYKKMGTLVITGALAISLAGCSDTEETAKKVSNDTKTEQTTKKKEEKKKFKVGETIKLGNHKLTVTNVEKSPGGEFDKPKEGHEFLIANVTIENGGKEEIHYNAHDFSLQNSEGNIVDPTLTMINQDTQLNFGKLAQNGKITGTIAFESKQGDPKLQLIFKPISLSEEEVRVNLQ

SEQ ID NO: 28675 - protein, 175 aa, Bacillus mycoides Rock3-17
MYKKMGTLAISGALAFSLSACGETEETAKKVSNDTKTEQTTEKKEEKKEFKVGETIKLGDHKLTVTNVEKSPGGEFDKPKEGHEFLIANVTIENGGKEEISYNPFDFSLQNSQGNIVDQAFTTVNQDTVLNSGKLAPSGKISGTIAFESKQGDPKLQLIFKPNFLSKKEIRVNLQ

SEQ ID NO: 28676 - protein, 704 aa, Bacillus ohbensis
MKNLTVLLKTIPLALLLFILLSLPTAAQADVTNKVNYTRDVIYQIVTDRFSDGDPSNNPTGAIYSQDCSDLHKYCGGDWQGIIDKINDGYLTDLGITAIWISQPVENVYALHPSGYTSYHGYWARDYKRTNPFYGDFSDFDRLMDTAHSNGIKVIMDFTPNHSSPALETDPSYAENGAVYNDGVLIGNYSNDPNNLFHHNGGTDFSSYEDSIYRNLYDLADYDLNNTVMDQYLKESIKLWLDKGIDGIRVDAVKHMSEGWQTSLMSDIYAHEPVFTFGEWFLGSGEVDPQNHHFANESGMSLLDFQFGQTIRDVLMDGSSNWYDFNEMIASTEEDYDEVIDQVTFIDNHDMSRFSFEQSSNRHTDIALAVLLTSRGVPTIYYGTEQYLTGGNDPENRKPMSDFDRTTNSYQIISTLASLRQNNPALGYGNTSERWINSDVYIYERSFGDSVVLTAVNSGDTSYTINNLNTSLPQGQYTDELQQLLDGNEITVNSNGAVDSFQLSANGVSVWQITEEHASPLIGHVGPMMGKHGNTVTITGEGFGDNEGSVLFDSDFSDVLSWSDTKIEVSVPDVTAGHYDISVVNAGDSQSPTYDKFEVLTGDQVSIRFAVNNATTSLGTNLYMVGNVNELGNWDPDQAIGPMFNQVMYQYPTWYYDISVPAEENLEYKFIKKDSSGNVVWESGNNHTYTTPATGTDTVLVDWQ

SEQ ID NO: 28677 - protein, 1348 aa, Bacillus phage 0305phi8-36
MVTKTKRKKKLNVVSDDEIFDFSDDLDAVKSNKKPRRIVHIHMHSIFSIADAMCKPKETAKRAKQLGIDTIILTDHGNISGVIQFKKACEEEGIKFIPACEMYEAKDRTVISKADCARGNWNASRHITMIPVNNQGWADLQHLISDANQYVYYAPKPLPRTDMNYIESNGLGKNIIATTGCLASETSQLILEGKEEEAKQEILRRNNLFYRYFLEIQDNGSREQEIVNEALIRISNDTGVPLVYAKDVHYVKPDDKDAHHALVAISRKQSVYDCAPYSGTNTYHLASADEVYQWADENNVPHSAIENTCWIADNCNVDIELNKDLMPEFPYCPDGHTDASYLKKLLFDNLIGYVEFVEVNGYKINVKEYIERVEHELRIVTMKKYPSYFLLLWDILLWASDRNKWLSYPQNKEWIEAEVHEVVVKVVKDKQTGKKKKVKRKVVSKPNAKYAFYPEFLVGPGRGSAAGSMMAFLLDITRLDPIQYGLMFERFLSPYRDSPPDIDVDFPGDNHDMLLDFVAQRYGRDKTAQVLTFTKFKLKSSIDKICKALEKRDPDNPKKVLEYGYKVADEVKATLKETGDQGKMPDQKDCTYKDMMEISVHPENYARYGGSLSKFVEASKQFRKLMTKYPELNDYLGKIEGAIDTSGIHAGGVIISKRPLDLDCPTIKPTEKSKAVLPITMWDYPDCESVGLLKMDLLRTSTLRIISTTIDLIEQSTGKRIDIYSIGRDDPKAFEVMAKGETHGLFQVAGRGITAYTRQVAPAKQEEVIDILALFRPGPLDATLENGNTIAQQYVLNGSRKPKEYLSDVHPDMRALLKQSRGQMVYQEQIMGLVQVIAGYNLGHADNFRRVIGKKKIDEMPKLYDEFMYGHKYVIEKFENLLAKYDSMPKHTDKDGNEGVIIKSDYDGNDLFLRKQDIENTIKKNKKAMDSHEIVGAVTNNYKESFAKNLFSQMAAFAGYAFNKSHSACYADETYQTAWLKVHYPVEFMTALLSVRGGDKEKTMENLKEAKRMGIRILPPDINKSYADFSPDAGAIRFGIFSIAGVGEKAVRAIVRERDNNGDYKDFDDFYTRCVVKFVKTEEQKSNPINRGVIRTLIEAGCFDTFERNRYNLLNHYNFTLRKDKVWNGLEEDLLTSKEKANHSFAYDPAQFNEKRMLQMEHELIGIYVSGSPYEDLPFTPLLDMDVSRGRRDKKEYDVGGRITKVRTIKTKRKEDMAFVEIETQLEPLEFTVFPDVFKSCSQHLYKDNIVVVRGYREKSYYNGEEKDQFIASKVLVRDAKKLKKQMGIKTTMPLAQVEAPKEELAVVEQSVPVKKADPVADLFDEEPTPKRKKKRKSGKVDVESYII

SEQ ID NO: 28678 - protein, 104 aa, Bacillus phage 0305phi8-36
MAKFLDGYEGIQVLGARAVIKLEKESDTTASGIILPTGDKDPKFEGVVVAIGDGQRKPDGGRIPMDVEPGQRVIYSRMAGVPVSLDGEEFLVINERDIIAVITK

SEQ ID NO: 28679 - protein, 235 aa, Bacillus phage 0305phi8-36
MNRNQVATLFAVILTIGFVIYSAFQVEGEFKKYDKALLEKEKVISVMEKKVSTQNNTIAGLENEVAKATEEKTILDNSLNNKETELQQSKERIDSLQNELSKAQADLDNARKEVKNLQAKKAEPAGDIPPSDGGRTLTVKATAYTAHPSENGGTYGGRVLTKTGYDLSANPGAKVIAVDPSVIPLGSKVWVEGYGEAMALDTGGAIKGNRVDLLMPSFQASESWGVRNVQLKVLN

SEQ ID NO: 28680 - protein, 203 aa, Bacillus phage 250; identical to SEQ ID NO: 27809

SEQ ID NO: 28681 - protein, 185 aa, Bacillus phage BCD7
MKKVNRETIEVHYSGIMRELGIERNADNADTPLRVAKALIEMTENEGKDPYEELAPICTTFECVGSSLVEQDGITISSMCSHHHLPFIGKVYIRYIPGAKIIGLSKFARIAEWFAKKPQVQEDLTTEIYDFLIEILQPEALEVEIYDCIHTCMCARGVRSEATTTTRRIYRPDVFERYYARGGRK

SEQ ID NO: 28682 - protein, 176 aa, Bacillus phage BceA1
MAYSGAHGPAFENLINWSNDMYRNNEIALIEKRATPVVVTKKYRDGRIKEGYYEKKSTVDYDGIYKGRFIAFEAKATIKEKRFDLSNIKPHQYKWLLQAEQMGAICFILLEFSKEHSIFLVPFALIKEYMKAAENGGPKSIKREVFDERAYLVTPTNRALVDYLYYVDKLEWPSIS

SEQ ID NO: 28683 - protein, 495 aa, Bacillus phage BPS13
MTATKNPMLRTDFYKTGHAPQYPEGTEFIYSTWTPRSNKYMPYTDGVVSWGIQGMIKEDLIEAFEEHFFNLPELVAVHQYTRILEYSLGKDKADGSRIAALHRLGYLPVRIKAVKEGTVVPIRTPMMTIENTHKDFFWVTNFLETIISNQLWQAMTSATIAYNYRKIMNEFAEKTMDVPELVKWLLHDFSMRGMGSLQTTEKSGSGHLLSFVGTDSIPAIVYLEKYYKANVETELVAGSVSATEHSVMCASAGEDLDEYETFKRLITEVYPTGIVSIVSDSFDFWDNVSRVLPKLAEEIKGRDGKVVVRPDSGIPEDILCGDPNADNKWARMGLVAALAHFFGYTVNSKGYKVLPPYIGAIYGDSITYERMITIYSRLEAAGFSIENVVLGVGSYTYAYNTRDSLGFAMKATWAQIKGEEKLIQKNPKTDDGTKKSNKGRVAVVEQDGKIVTIDNISINDAPIEGDLLETVFEDGKLVREQSLQEVRDILASFTK

SEQ ID NO: 28684 - protein, 525 aa, Bacillus phage G
MKKTKLTTAGKALIFGLVLLIVAGVTYFAGGFNAVSNLFSGSDDSGSTQSEKVDIVGSGSTKDDGVINVSLDEWIGWKSVIDANGGLETAKGSIYDKLGIKVKIHVINDANQSSNALIKGDLDGAGYTVNRYAFLYPKFKENGVNVVMPYVTNFSSGGDGIISKSDINSVEDLVGKKIAVPRFSEAQTLVEWLLAKSDLSDKDVKEIRKNMVMFDTPDDAAKAFFAGQVDAAATWQPYLSQAQETTGAKLLFSTKVAENIILDGIVFRQDFIDKNKEAVVKFTEGALEAMDLYTKEFSPIKDTMPLFATESNENIVAMAGDAKLASYNENKSLLTNEAVTLFTDMSNIWKTLGETSFPDEAKKAFTTSIIDSVDSKFASSVTADTNKPKFTEEKRQEAKQVDNVNSLLKQSATIEFQPNSAAFANAAEASKVLEEFVKTAQILNGSIIQIEGNVNNTGAGNDEAISKKLSEQRAKAVAMYLQQQGVDATRFVVVGNGTTKQIGDNNTEAGKAQNRRTDVFFKIVE

SEQ ID NO: 28685 - protein, 518 aa, Bacillus phage G
MKKTKLTLVGKIVIFVFVLALVLGGVFLIGGFNFSKDDNDTPSKDTKTTQNSNVSNELPKNENSNNEINLSLTEKISWKPILDANGGLTTQPGSVYDKLGIKVNIKIDGDAVSISNDFIENNVNALAYTINRYAGTYKKFKDNNAEPIMPYIVDSSDGSDGIVVKEGINSVNDFIGKKIAVPNLTAAQTMIWWLMLKSDLNEDQIEKIKSNMTLYKSTVAASEAFFKGEADVVVTRQPYLTNAKNTPGMKVLFTTKSANNLILDGILFRKDFADQNPEVVSKFIDGALQSININTFDNIKTIDIFKDKTDEELNQMLTELKFSDYSANHNLLNGVSQDLFNDMNKVWNKIGESVDNDAASKAFSTKFIDGLSSKYTLEKVETKTVDEETRQKALSQDNDEALLKKSTTINFKSNSAKFVNEDEAKKALNEFINIAQFLDGAIIQIEGNIAGKDNSEVGKQLSLQRAKTVAEYLKQQGVDPSRFVVVGNGTSKQIASNDTEEGMKKNRRTDIVFKIVEE

SEQ ID NO: 28686 - protein, 656 aa, Bacillus phage G
MSSEKDNLTVNTDYGVEQIDALEGLEAVRKRPGMYIGTTTQKGVTHLVWEAADNSIDESVAGFGSEVWISVETDGTTTIKDKGRGIPVGPHPKFKNADGTQKDTLTVVCTQLHAGGKFNQAGSAYKSSAGLHGVGIKTITALSDHMVVEVRRNGKIHRQEFSRCYPVTEVEVIGECDINDTGTTVQYHPDAEIFKQTLLPDCKSLQARMAELASLNAGLRIYYTNESTGHIEDYYYEDGLIGYVNRMVGEKPSLYDKVLYFKDTYDVDENRQIIVEIAFRHDDDDKAGETIKSFANNINTHEGGFHYDGFRKAYRKFLNKYGEDKGLLKAALPMGYLLEGINAVVSVKVPEAEFEGQTKTKLGNAEAEDAVIAVFEKGISEFSKDPEADEILETIILKSIRAKEADEAARKARQLVKQGKKAKKLALPGKLADCTSKTYSELYIVEGDSAGGSAKSGRNRYYQAILSLRGKILNVEKSSLERMLNSEMIKNIIGAVGTGIDSPGQKFEYEKLRYDKIIFMCDADVDGSHIEALLLTLFYNYMRPLIEKGHVYAAQPPLYRVVKKNESIYLKDDHELKEYTKKHPNAEVQRFKGLGEMNADQLWETTMDPKERTLLQITLEDAERASTVFSELMGGDAKPRRDFIEANAHKVDLSFT

SEQ ID NO: 28687 - protein, 823 aa, Bacillus phage G
MARSNKKNEKIDFEELLANENIKKRNVVDQMENATLNYAVKTIIDRALPDARDGLKPSQRRILYALWDLGMLPHKPYRKSATVNGHVMGNFHPHGDTYGVMVNMTNELSIRYPVVDGQGNFGNPLDGDGAAAMRYTEARLDNLGMLMLQDVDKKVVDFQPNYSEETEEPVILPAGIPYLLINGATGIATGYTTDIPSHNLSEVIDGILNLIQNPEIDIHGLMKHIKGPDLPTGGIVVKNEDLIKLYETGRASLRYRAKMTTEINEEGNTQIVVTELPPDVRKASLEKSPGIVEKLYQLCVVDKKIPRIVDVRDESEGKKDKKTGIASDQVRIVIELHKTAIPEVIISELYKKTALEKTNGYLLRALVNQAPVILNLKEMLEIFLNHRRDVITRRVKFDLEKTKRKLHLLEGFIIVFNNMDDIIHIIRNSSDVEQDLVAKYGFSKEQVKAILAMPLRNLSKMEETKILDEIQQRKDEIEMYEFILSDQNEIDAIVKSELVEIKEKYKKDKRKTTVLCENELNNSLNMMSDESMVSILTSKNAIKQISEESLDDMLKAGAFRERTEVYIQGVKCKIDDEFVLILETGEYVRATFNDLALMDFVESKKVVAFFVLDLQDSQKNVVVMTKSGLIKKSKMSSFKARSRRIAPYIALANENDTIVGVKISDGDELNNTVVVATKNGIVHRFSENAFTPSNPGGKGVPGISASVIEEGDEIADFDVVSKNDDSTNLLVMYSRDKEGNISMKSMSMSEFITKGRVSRGIVGAAKDFSDEVYKIKVTNEDLVIIDKKGVIHKQKFVSLPIQSRYNKPERIDFEPLVTDFYLE

SEQ ID NO: 28688 - protein, 487 aa, Bacillus phage G
MLNTNENLTTFTDLYQLTMMYGYFKERKQDEEVVFDLFFRRNPFKNGYTIAAGLENLIDYIKNLSFSHEDIDYLKSTGLFPDEEFFKELRNFRFTGNIKAVEEGTVVFPSEPLVRVHTRLFEAQLIETALLSLVGHQTLLATKANRIVRSAEGKNVIEMGARRGQGPESSTLGARAAFIGGVGSTSNVSAGRKFGIPITGTHAHSWVMSFDSELEAFQKYGKHYPDNLILLVDTYDVINSGIPNAMKVFKEVSERLGRAPKKFGIRLDSGDLTYLSREARKILDAAGFKDAIIVASNDLDEYTIRELESQGALIDSYGVGTKLITAYDQPALGCVYKLAAEKINDEWVPRIKRSENVEKVTNPGMKKVVRFFDNETKHAIVDLIMLDEEEIPQQPFEVFDQVHTWKRKVVNNTNCVELLQPIFENGELVYKMPTIQEIVENVKHNLNTFSEYHTRFSNPHEYHVDLSQKLWDTKMDLLKKTDFKNKG

SEQ ID NO: 28689 - protein, 230 aa, Bacillus phage G
MDFQVQNGIYNLGFKLSKLEKILLDEFSKKLEDKGFNYLSIPTGITWETLLMQGVVGVNGTHYIDNSHCLGGSAEQGILQFFSRQEVEPMKIYARNQCFRKEDKYEGLVHLKEFTKIEQFCFCYEDDWQENFELVLRNSEDFLKEYQIPYRVVNVTDSDQGYHVKKYDIEIKSEKLGWVETHSCSYFGEQQAKRFFISGATHTISNTGIATPRILIPFIENEDLIPEFLK

SEQ ID NO: 28690 - protein, 765 aa, Bacillus phage G
MQAVELRNLYHTLSKERKEELAQQCKDVFVNIHCHSFYSLLDGMTRPKELIKRTLELGQPAACISDHGQMYSLVDFVNLASESKQKYMIAMEAYVVRDHRLKGKQEADTDNNSREHLLLIAYNDVGYKNLMKLASIGATEGFYYRPRIDDELLKRNCEGLIATSACLGSRFSQMFARGDDEGAKKELIKYAKMFPGRFYLEIQPTKEYLQKIVNHKLVQISKEIGIPLVATTDSHYLKREDSVAHGTLLAMQSNDTLDNPLRWTFPGDTFFVSTRQEMIDMFFEDCTSEVDEKLLQRPTEEWVLSDEDKMYTKTIDFISKKTGKPDKVDKTYMDFKHDIPLEIIEEACDNTVVIADMCNTEIKFDQTYLPKMDVPHDNKEFVSWRKNRVLRLESQGRETQTEQADYLRYLCIKGLKDKKLDTLEYRERLEYELDVIISMGFPDYFLLLQDVVNWCFKNDVPVGPGRGCFVPGQTVNTKNGKKNIEDVKVGDLVLTHRGNLKEVKSIQKYTSDEEISVIKWKKHGESEVKEVKSTSDHEYFIVPKHYGKDFKNTKWAMANELEKGDLLLLPIQRKDACKHSHKGHEGCINCFGKQNPDFIEEANKQFHETAFNASRVVEKTIKTLNSKINDDGQEEVLDGAIKVLQNMQEVFGFNEVINSEISIEEFSEDLLKLGYELAYVEEINYEHYKGDVYDLTVEGDTSYTVNDLAVHNSAAGSLVSYAIGITNVDPIKYGLLFERFLNPTRGKLPKQYWASKVNLAQGCAA

SEQ ID NO: 28691 - protein, 158 aa, Bacillus phage G
MKYIMERFGQEHTANIATFGRLQTKAVIKDIGKAMNIPFEEVNAFTKLLPSGPGASIHIHEVVDMPEAQFFVNKYPLLFEFAAKLESSPRHVSQHAAGMVVSPPEHPIWSLIPIQKGKEVADGVAGYLTQLEKGPVEALGLDVTWAKYKKVGYMLGSS

SEQ ID NO: 28692 - protein, 606 aa, Bacillus phage G
MLGNNSYFKNKENTRNITKRVKFDILGLKNITELYEQFAIVKKIYGVDINFDNIPFDDQRTWDLISKGRTLGVFQFASPLAISVITKMKPQNIEELSAANAFIRPGASGLEEYMIAKANPLKRKKMAAELDKHLDVTYGSIVYQEQIMNLIAEVMGIDFGEADIYRRMLEDAAKGKDKAKAQLAQWKIDFTAKGLEKGYSQKLTDLLVNLLIENSGYGFNKSHAVSYSIISYWTAYMKANYPLVFYTAMLNGNVDDAENFMSEANKLDIKVLPPHVNESKLEFSIDSKGNIRAGFNAIKGVGPKAVESIMANQPFNSVDDFYERNDKAAINKGVVTALIKAGAFNDMGIKIREEDIPFELRDKFEFQSIDDEEYVVLNREQMKQWNEYLNDINSKKPVAKYLVPTQFIPGKYFDQYELVEEKDGSGIVLPEDVMQKMKISISSLPDQTKTRKKPKGSFDSANDPLKKIEPFRKPFILHSRELSQITISYLDLYLQETEDFGFSFLPHPLENHMDKIQLFDDIQDGQTMVTAGIITSIIQRKTKTNKPFYWVTIRTPRDNVRITLWDNVFAKYKEHMKKNGLLLVKGSKGFGGITPEIIRGLSFKKE

SEQ ID NO: 28693 - protein, 315 aa, Bacillus phage G
MTNNFYDVIIIGGGPGGLTAATYTSRANMKTLLLDGGFPGGQLQNTAEIENYPGFDNISGPDLAQHMFEQALKFGTEYKYGIVESINPAEYTAAPFFFVETAKEIYSARSVIIATGTKYRTLNIPGEKEFTGRGVSWCAVCDGAFYKEKHVVVVGGGDSAVEEAVYLTKFASKVTIIHRREKFRAKQILVDRLLKNEKIEIIYNSVVEEIVGDEKVTSVLIKDVNSGNISNLSCDGVFEYVGMDPISGFVKNLKITDEFGWIITDSKMQVTSNSISGLYAIGDVRKDAIRQVVTAAGDGCVAAQMAQHYVEMWNN

SEQ ID NO: 28694 - protein, 479 aa, Bacillus phage Gamma
MKKYGGEKMDCFKKGKFIPFPCALPIPEAGPTGPTGPPGSAGGSTGPTGPTGPQGLQGIQGVQGNPGTTGPQGIQGIQGIPGVSGPIGPIGPTGIQGVQGIQGFPGIPGPMGPIGLTGPTGIQGIQGIQGVQGIQGIQGDVGPTGPQGIPGIPGLTGPTGSQGVTGVTGPSGGPPGPTGATGPTGPAGGPPGPTGPTGPAGGPTGLTGPTGPTGPTGIQGIQGVQGTQGIPGPTGPQGIQGVQGLQGIPGIPGSMGPTGLTGPTGLQGIQGIQGNPGPTGPFGPTGPTGLQGIQGLQGIQGIPGPTGPQGIQGPTGPASTLSTKAILFGGTNSGFQRIAGSPGADSQDIPYVLGGAGSVVGLSASISINNLPIGVYTIRVCKNVPINLAAPGPGQVISTIILTTTAVISGTIILTINPSDIGAQPVRVFNPNLVIAPATVAWSSTIPGDIVARGDAMSLFITPGITQNAVYTVFLHTGN

SEQ ID NO: 28695 - protein, 471 aa, Bacillus phage Gamma; identical to SEQ ID NO: 28483

SEQ ID NO: 28696 - protein, 203 aa, Bacillus phage IEBH; identical to SEQ ID NO: 27809

SEQ ID NO: 28697 - protein, 135 aa, Bacillus phage phi105
  Bacteriophage phi-105
MWMNFESLQIARAYLFGEVKYLDLMLVLNIIDIITGVIKAWKFKELRSRSAWFGYVRKMLSFLVVIVANAIDTIMDLNGVLTFATVLFYIANEGLSITENLAQIGVKIPAVITDRLHVIESDNDQKTEKDDQAAG

SEQ ID NO: 28698 - protein, 86 aa, Bacillus phage phi29
  Bacteriophage phi-29
MGKIFDQEKRLEGTWKNSKWGNQGIIAPVDGDLKMIDLELEKKMTKLEHENKLMKNALYELSRMENNDYATWVIKVLFGGAPHGAK

SEQ ID NO: 28699 - protein, 88 aa, Bacillus phage SPbeta
  Bacillus phage SPBc2 or Bacteriophage SP-beta
MFENIDKGTIVRTLLLAIALLNQIMVMLGKAAFIINEEDINHLYDCLYTIFTIVFTTSTTTAAWFKNNYITAKGKKQKQVLKKENLFK

SEQ ID NO: 28700 - protein, 1305 aa, Bacillus phage SPbeta
  Bacillus phage SPBc2 or Bacteriophage SP-beta
MIGCHCHTDRSNIRLLDSTNSVKELLKTAVKMEYKGLAITDHEVLSAHLDAIRTVREMKKKGDMPEDFKLILGNEAYLVDSLEEVRDNYKSGVTKFPHFLMLAMDPKGHEQLRILSSQAWENSFYTGTMERVPTVKKDVEELLSKDPGHIIATTACLGSEVNIHLLKIKAFEETGDSQSIKQHKLKIHEFITWCIEVFGKDKFFIELQPALSEEQIYCNKKLIDIANGYDLQMIVTTDAHYLRPEDRAIHQAFLNAKDGEREVDSFYEACFVQNVDEIHERMDYIDKEVIDQAIKNTMLIGEMIEDYTIEHEPIIPKMELPNFKLRHLFKPAYDQYEYIKKMSESADEQDRYLLKLIEDGFEEKLKTSELTREAFHKILNRINVELGELWEISQKLNQSMSSYYITVREIINIIWDDECGGDSLVGAARGSAAGYLVNYLLDNTQINPMQYDLPHWRHIHKSRPDLPDIDIDTEGSKRQKILKALRERFGDKRVLQIATFGTEGSKSALQTACRGLGIDNDISQYLSGMIPFERGSNWPLKHCFYGDKETGRKPIKEFIREVEQYPNLKETALKIEGLTNKRSSHAAGVIIFNDEYTKSNAMMKTPKGAYITQFNMGDSEAMGSVKFDLLTIEALDKIRVTLDQLIENNEIEWQGSLKETYNKYIHPDVIEYEDDKLWEMAGNGEIMDLFQFSTEVGHQSVVKVKPKNLLEAAVTNSLMRLMSDGEEQPVDTYVKYKNNLNKWYEEMTRYGLSEKEIRVMERHLKDIYGVADTQEVVMQMVMDKDIANFDIKESNYLRKSIAKKKEDVLKEVEELFFKKGKEIGTSDNLLNYVWNVQFKRQFGYSFSLLHTLAYSIIALQELNLNYRYNPLYWNTACLTVNSGGIDTEDTKDNKKTAATNYGKVASAIGNIRQRGIKIDLPDINKADFGFRTDINNNSILFGLKGMNGIGDDVIHHIVLNRPYSDFNDFIERMFKSGIIKKGQVIQLIKGGCFDSFGNRQEIMKAFISLISEPKSKLTLSNLKMLIENNIVPSEFAQEVRFFRFKDYISKKVYKTLKSPKDKLFLLDDVSASFYNQHFSEDSVVDMLNGQLVISEKAFKKEYDNKMSNIKSWITTEEPLKKLNDCLLIKEWEKYADGSLGKWEMDSLSYYYNDHELSGVNFAKYDIADFYKLPAEPVKGKPYQWRGKTLYEYETTRIIGTVLDRDKNKHAITLLTPTGVVTVKQWSGSFSHYNKQISRSIGGGKKEVIEKSWYTRGTLLMFTGFRRGNNFIPKVYKDSIYNHTVCRIDFVDNEGSMSLTTKRAEI

SEQ ID NO: 28701 - protein, 137 aa, Bacillus phage SPbeta; identical to SEQ ID NO: 5079
  Bacillus phage SPBc2 Bacteriophage SP-beta

SEQ ID NO: 28702 - protein, 148 aa, Bacillus phage SPbeta
  Bacillus phage SPBc2 Bacteriophage SP-beta
MNTRYVKSFFLLLFFLSFFGTMASLFYSEIMHFKPCVLCWYQRIFLYPIPIILLIGLLKKDLNSIFYVVFLSSIGLIIAFYHYIIQLTQSKSVVCEIGTNSCAKIEVEYLGFITLPLMSSVCFALIFGIGLKLIIKSKKLKQNQHVYN

SEQ ID NO: 28703 - protein, 104 aa, Bacillus phage SPbeta
  Bacillus phage SPBc2 Bacteriophage SP-beta
MEFKVGQDVSEIWNIHGSILPEVLMYMFPRSDESYDWEFVNDNGRHIFTAWRKSEPIPTLEEIEKAAIELEEKKNAPKPKTLEERVADLEKQVAYLTSKVEGTN

SEQ ID NO: 28704 - protein, 56 aa, Bacillus phage SPbeta; identical to SEQ ID NO: 5080
  Bacillus phage SPBc2 Bacteriophage SP-beta

SEQ ID NO: 28705 - protein, 705 aa, Bacillus phage SPbeta
  Bacillus phage SPBc2 Bacteriophage SP-beta
MNKKKKYVHTKQFNSHDCGLACISSILKFHNLNYGIDFLLDLIGDKEGYSLRDLIVIFKKMGIKTRPLELQENKTFEALKQIKLPCIALLEGEEYGHYITIYEIRNNYLLVSDPDKDKITKIKKEDFESKFTNFILEIDKESIPEKEKDQKKHSYFFKDILFRNKLIVFVILLTSLFVVGLAVAGSFYIKFLVDLIIPRSLRESLITITLIFISMVLIRCIFDFVRSYLIIKLSYKVDKEMSNVYFNKVTKLPINFFENREDGEVISRFNDGIYIKDFFSANFVTAIIDIILILGLGVILYRTNNILFLTIILPILLLSCLAILFFDHLKKKNQKLMEDKAKSTSLLINFLKNMTTVYSLNKTSFFLEKFHLTYDKQLNSTFSVAKAVISNEILKGLIQNSFTIIILWVGTRQVLNDSMSLGTLLFINTLAAFLLSSLDRILSMQSDLQQAHVASIRFFDVVNYPVQQDSNENLTELDFIQNIKTVNLNIGADPMRYIVEDINLILDRKDKVLIIGESGTGKSTFAKSLSKLYKVPDKSIYLNGLDINRYDHLSIRKRIVYIDENPFLFKGTIKENLCMGEIFDQNEIENACIMSQCHEFICNLDKQYSYKLSENGSNLSTGQKQRLALARAILHQPQVLILDESLSNIDPDNTKLIYETLHRMDCLIILITHNDPSNFKYNKKLVFRNNRIIESSYSENKEYSI

SEQ ID NO: 28706 - protein, 495 aa, Bacillus phage W.Ph.
MTATKNPMLRTDFYKTGHAPQYPEGTEYIYSVWVPRSNKYMPYTDGVVSWGIQGMIKEDLMEAFEQHFFNLPELVAVRQYTRILEYSLGKDKADGSRIAELHRLGYLPVRIKAVKEGTVVPLRTPMMTIENTHDDFFWVTNFLETIISNQLWQAMTSATIAYNYRKIMNEFAEVTMEDPELVKWLLHDFSMRGMGSLQTTEKSGSGHLLSFVGTDSIPAIVYLEEYYNANVETELVAGSVSATEHSVMCASADVNLDEEETFRRLLTEVYPTGIVSVVSDSFDFWDNVSRVLPNLKDVIEGRDGKLVIRPDSGVPEDILCGDPNADNEWARMGLVASLAKIFGFTVNSKGYKVLPPCIGAIYGDSITYERMQEIYSRLVAAGFSIENVVLGVGSYTYAYNTRDSLGFAMKATWAQINGEEKLIQKDPKTDDGTKKSNKGRVAVVEKDGKIVTIDNISINDEPIEGDLLETVFEDGKLVREQSLQEVRDILSSFTK

SEQ ID NO: 28707 - protein, 471 aa, Bacillus phage WBeta; identical to SEQ ID NO: 28483

SEQ ID NO: 28708 - protein, 213 aa, Bacillus pseudofirmus
  strain OF4
MKKTALIVSAVTAAMLITGCGEEAAIEKVEESTEVSAEAASNGGTEGEDIDIEEEPSEASEVGTRSAPLQMGERVTLDYNDLFYGNVSLEIELLEVISGDEAAELVSLGNPFNDEPGENQEYVLAKYNVKANQVEEEPFDLNHAQFDAVSESGNTYDEFISVAGLEPDLGNELYTGAERTGYTYFLVDKDDQNPLAAFKRRTEAELWFELKSE

SEQ ID NO: 28709 - protein, 597 aa, Bacillus pseudofirmus
  strain OF4
MIQTKNMLKVIRSLIIIGIFHLLITSTVFGEGTFTSHSYGGKTYKLYVPSSYHTSEPVSLVVMLHGCTQDANQFAAGTEMNTIAERESFIVLYPEQTSSANSSRCWNWFETGHQARGSGEPAVIAGMVQQVKNNFAIDSDNVFVTGLSAGGAMSVIMGATYPDVFSAIGVAAGLEYKAATNSIQAFTAMSSGGPNPKTQGTLAYNAMGQYKQVMPTIVFHGTSDYTVQPINGDQVISQWAKTNDLAYGGVENTYINDTPNQTKQGQVSGGRSYTNYIYQDKYGITILEKYLVNGMGHAWSGGSTQGSYTDPNGPNASELMWQFFMQERGEQDPNEDDPGEGAPPMTTASPNGGTYTSPVSVTLQTNREAKTYYTVDGTTPDENSPVYSEPIFIENSSTLRFYSVDSNGLSEELRSEDYMITEAANEVILSSIAQEDGFVGRFSADGLSTSILKVGDKGMYNTDTYRTILSFDTSSLSSTHTLKGAKLRVYRKALQGNVQTMDVDMKVNAFGTSSSLESIDYSSAATYSNLLTAQVPSQDHQFVDFELPSHVLKEIASNNKLQFRIKSATTASFTSNVLEIHGGEHADYAPQLIVIKD

SEQ ID NO: 28710 - protein, 429 aa, Bacillus pseudofirmus
  strain OF4
MTMITDVYAREVLDSRGNPTVEVEVYLESGAMGRALVPSGASTGEYEAVELRDGGERYMGKGVIQAVDNVNDVIAPELIGFDALDQLGIDQLMIELDGTENKSKLGANAILGVSMAVAHAAAEALGVPLYVYLGGFNAKQLPVPMMNIINGGEHADNNVDIQEFMVMPIGAENFKEALRMGAEIFHNLKAVLKGKGYNTAVGDEGGFAPNLSSNEEALSTIIEAIEKAGYKPGEEVVLAMDVAASEIYNKDDGKYHLSGEGKVLSSEEMVSFYEELVSKYPIISIEDGLDENDWDGFKLLTDRLGDKVQLVGDDLFVTNTTKLSEGIEKGIGNSILIKVNQIGTLTETFEAIEMAKRAGYTAVISHRSGETEDATIADIAVATNAGQIKTGAPSRTDRVAKYNQLLRIEDELANVAQYGGRSAFYNLKK

SEQ ID NO: 28711 - protein, 110 aa, Bacillus pseudomycoides DSM 12442
MSSRTDPLINAEDNFSSDSELPSLVRFGFQPSTMAIIIADKNATSTDLSVKHARERDVYTLSYEYLKGWIGSNSKTYKHPHDKFGTIDNYKIDWQNNKIIHQSSSLQTWN

SEQ ID NO: 28712 - protein, 127 aa, Bacillus pseudomycoides DSM 12442
MHSLDSTYNAEANIKNSIKVSFIDDPNTDKKYAIVFTEGSNIASNFSRGTGTYSAQIFWPSAFKTGLEITSNDNAKFYKVSPKNEIESKTVSSTVSYNVGGSLEVKPEGPSSSVSAGASWSNTISYE

SEQ ID NO: 28713 - protein, 769 aa, Bacillus pseudomycoides DSM 12442
MTMKKLKPTLSVLGSVTMALTLASPALAETTPEQDGKVETFKENKNMKEGQNIIYDGSEKKGIIIMEEPQENNDWDNDGIPNDVEEKGFKIVFNKKTGKNEAQPWDQQQDFGEKRFITNPRSANSDGDPFTDSYEVEHYGSDSDVDFNPMIANVPNLQIAVKRIDITPVASITDSNGESRTKSWEKSLSVQHSFNVGLAGEAGAEGSAAGPVPSGKGSLNVGYGYSNTKTETESISNSFDWSTATTVDSAKAANVRFHLEYKNTGTASAGDVSPHFNIRLGNKIINTVKATQDRYKANLLTTEKGGNNKTEILMDSVEGQADVKISLTLDELKAVEQGAPLSIEVLPTSTMNVYTMKDGKFENLGDWAHFASNVNASTTLVETNLGSIPKFRVYTPKKDKTKPASVDHNLSLDEFFKNSGIDSYAWTANAVVNGQLNKNLVRYGPNRSLLERGVNLGFFDNRVLRPTLSYSSYDYSKKKIYASVIPGLFNISEEIFVTVNNKEGKQQKVKLVRNKNSNVYESKENEPVDLAVNKRALGETPVKFELNDVQNNKTEVSVPLVSNKSYLEAIDKLVVDNSGEPILEGKQYYLKTNVNIREGVQEDWHIGLSQTINGRYVHFSPQSNWDRLRLGPIQKAIHGADIQATPVMIERKGQPKPGQPFKKDEEVFLKFTNSSYSGYQYLNIGNGYDYNWLDTENNRSSIKLDKLPNEKSFYLKSDSTYITFRQNNWTASVADNGSAPVVASSEFILKPEHTNSPGNNHKWELESIK

SEQ ID NO: 28714 - protein, 975 aa, Bacillus pseudomycoides DSM 12442
MDFINGGNVMNKKSKFTQMMLGISTVALSFGSIQTQVSAEENTPYNVLKKKPIGIETSTDEIAHSTKADETLSYEERLKVNDFSQRPTPIVKRAVAKQSQQKYSLAELNRMSNDEFIDTLASISWNQITDLDQFNQETKAFYQNKERIQVIIDELGRRGSTFTKDDTKGIETFAEVLRSVSYVGFNNKEVNYLYERSFRDKCLPAIKAIAKNPNFKLGTDKQDAVVSAYGKLIRNASCDAETVQYAGNILKQYNDNISTYISDKNKGDALYNLIQAIDNDIQSYLQDTRKKADETIWYGKIDGFINEISRLALLNQMTTENTWLINNGVYYTGRFGKFHSNPNKPLEVLTQAMRMYPRFSEAYFNAVEQISTNYDGKDYNGNTVDLKKIREEGQQQYLPKTYTFDDGSIVFKTGDKVTEEKVKRLYWAAKEVKAQYHRVIGKDGALESGKADDVLTIVIYNNPDEYKRNSQLYGYDTNNGGIYIEGKGTFFTFERTPQQSRYSLEELFRHEFTHYLQGRYEVPGSWGQGEMYQDQRLTWFEEGNAEFFAGSTRTNNVVPRKSIISGLSSDPAKRYTAERTLFSKYGEGPEQWDFYNYSFALQSYLYTHQFETFDKIQDFIRANDVKNYDAYREALSKDPNLNKEYQDYMKQLIDNQDTYNTPQVSDDYLAEHAPKPLADVKKEIKDVAKIKDATITKHKSQFFDTFTLEGTYTGGVTKGESEDWKTMSKKINQSLEQLAQKEWSGYKTVTAYFVNYRVNANNQFEYDVVFHGVATGEEEKQTIKVNMNGPYNEILNEKVEFHSDGTESTGGKIVSYLWDFGDGTTSTEANPTHVYGKEGTYTAKLTVKDNKGKVGRGQTTVTVKKDEPAGHNYQEAKVLSFNKLSKGNMDRPNMAYMYTFNVTSPKEVDISFIDEQGIGINWDVYHESDLGNPVITGRADGNNIKGKFAAKPGKYYLVAFFEEENRKGTYSLLVK

SEQ ID NO: 28715 - protein, 497 aa, Bacillus pseudomycoides DSM 12442
MVAIATAIPLVLGTVSVVSAVEEKQVKIDRYSPQEKAAEYLKANAAQYSLKTDLSDLQYISTTDTQVASYVRFQQVVNGSPVFSKQITVTLNGKGQGVLAVSDYQPVQNVKEIKQKISEKDAEQKSKVYVGGESEQNLWAPTMKEFGYIIEEGVAIPVYRVVVHSNQPFGAWETFIDAENGKLLKKVDINRKAEGTGKVFLPNPVVTSGSVTGLKDNNDADSAALNNQLKTVTLKGLNGTGFLVGDYVTISSKAKTKSSTLQFNYTRSNDSFEDVMAYYHIDTLQRYIQQIGFKNINNRSIKVNVNGTRDDNSFYSPSTKDLTFGTGGVDDAEDAGIIAHEYGHSIQDNQVPGFGSSPEGGAMGEGFGDFLGATYEDATSTTGYGKACVGEWDATSYSSSNPTCLRRLDNNKVYPRDVQNEVHADGEIWSQGEYEMAQSFGRDVATKIILQSHWSLTPNAKFRDGAKAIKQADALLYGGQHAAEIDRIWTARGISTN

SEQ ID NO: 28716 - protein, 204 aa, Bacillus pseudomycoides DSM 12442
MGNNHFHNVFAVKQEHFGQVLKLKKFFEELDMDFNDFTDPRTLVNVLESNRDINFLKSSQEAIIGGEALQISELIEKISNMIIKDILAFPTYRWGESINQDIVSQVTDAITNMFINLNKQDAEPWIFWYNTGSVFPRYTYNILIAIDTQDKDYLTDVLAISFDVLVVKKTKQEVFSFTVNDSAQCLIMMKHMLVGIKFEDVYPS

SEQ ID NO: 28717 - protein, 200 aa, Bacillus pseudomycoides DSM 12442
MGGALVFNLSGCGSTSDKTSSESKETTSKQEEKNVKTKTNDTTKGNTDSKNTEQTKEKTKIKEKEYSLNKTFNTPKFDVTVKRVVERDKVGKESIGIQEPENGHVFIVIEVEGKNITNEPMKLAVLPSVDLVDENDNAYQSDVWATSSYEVEKGETSTISKELKPGDVKRGNKVYVINKEKFDTGKWYVLVNHEHKEQIK

SEQ ID NO: 28718 - protein, 251 aa, Bacillus pseudomycoides DSM 12442
MRLESLKAEKYGNEKMYQLGGRMAEGVDYIGKSIGKVPAENGNVLKTKTVQSFENLNLNGEAKKPLSNLEEAHEWGSKHFDNWIESLTESERSAIRQYTGDDYRKINNYLRGIADSLNDVESSVIDNIKSGLNKASVPYDIQVYRGTDLKPFKNLYKIDDEGKIVVDSLVGKTVKDNGFVSTAMVKESSFDHMNVSWEINVPKGANAAYVGKISYIPTEAELLFNSGQEMVIKSANVDSDGKIHLILDLIK

SEQ ID NO: 28719 - protein, 87 aa, Bacillus pseudomycoides DSM 12442
MNRQKEPITLNSKNFKLIDDLGREYYSSTEAQLALKAVNNATFKFDTLNPDSSSSGKIVFDVPKYAKGLVLQFNGDMLDKEIDLKVE

SEQ ID NO: 28720 - protein, 163 aa, Bacillus pseudomycoides DSM 12442
MKKKLLPICAMALLSVGYSSVASASTGTMTKEEVAQVQQDTTKKEAAMQEQQKQDKMKKEAAVQEQQKQDQMKKEAVVQEQQKQDQMKKEAAMQEQQKQDKMKKEGIQEQQKQDKMKKEAAVQATKGEKLPNTASNSITMMTLSACLVALGSLFGFTRRKIKA

SEQ ID NO: 28721 - protein, 430 aa, Bacillus pseudomycoides DSM 12442; identical to SEQ ID NO: 28657

SEQ ID NO: 28722 - protein, 351 aa, Bacillus pseudomycoides DSM 12442; identical to SEQ ID NO: 28658

SEQ ID NO: 28723 - protein, 713 aa, Bacillus pseudomycoides DSM 12442
MKKLKPALSVLGSVTMALTIASPALADVKQPNAGSTVEIFKEDANAKEGKVIYGTDGKKGKMSTEKIDLQNNDWDNDGISNDLEIKGYKIEFNGQTGKNEARAWNPETDKNKLKFITDPMMGNSDGDAFSDAYEVQHYGNNSDTEFNPMVANMPNLQIGVKRIKITPVASITDSNGGSINQGWEKSVSTQHSFGIGAGVEGGAEGSAAGPVPSGKASVNVSYGYSKTSTDTERYSSNLDWSTAKTVDSAKAAQVSIQLEYKNTGTASAQNVSPHFNIRLGEDIIHTSKGTQERYKANQLSTEKGGRNTTEVLVDSVENNPDVKIYLSLDQLKAVEQGAPLSVEVLPTSTMDLYMQEDGKYITLGDSGKYESDVNSATALLETDIGNKPKFRMYAPDNTSSDKNLTFNEVLKHVKVDSTKINEFIENSEGKQTIIAKDMLENVKESHVSKRTKVGVFTKIQQPELSHSAYNPFTKKFYASVVPGLFGASDEISASFENKKSKQTQQVTLVKKGNVYESKETVSLNDFNPTQQVTFEINDAQKKLPTQKISTVVTYNKEYEDYLKLQYSDELIVEGTPYTMKSNGYPVQSYKGNDNWEYLAVAGNYLKPVNVIIERKGQPKPGQPIKKGEEVNIKFQNSVHSGYSYLKLHDSYIRLDQKQNASTFKFDHVDARFGSTSNGDWALQSDGNYIGSHFNGYVSYGSKDNNRVTFEKAK

SEQ ID NO: 28724 - protein, 878 aa, Bacillus pseudomycoides DSM 12442
MVKYSKFYKLMLGVGLVTVSCNGLQVQAETKEKYTKNTLQMEPIGSRQSPDELAHSSNIQESTSFTKRLKLADLSQRPPMPKENTKQLVEERKYSMAELNQLSNKQLADLLVTIKWNQIPELFQFNNDSLKFYQDDSRMQALIDKLAEQGQTYTKDDSKGVETLVEVIRSGFYLGFYHQELSKLSERSYHDKCLPALKTIAKNPNFKLGTSEQNKVISSYGMLIGGASADVEIIQYAAGILKQYNDNLSTFIEDRTKGDAIYNLMKEIDYDVQSYMYTTDKEPKDTMWYKNIDSFINEVSRFALIGTVTDKNGWLINNGIYYASRFGKFHSTPTKGQQVVTEAMRIYPYLGQQYFVAAEQITTNYGGVDANGKTINLDKIREDGKQKYLPKTYTFDDGAIVFKAGDKVTEEKIKRLYWAAKEVKAQFYRTVGSDKPLESGHADDVLTMVIYNSPDEYQFNRQLYGYETNNGGIYIEGIGTFFTYERTPQQSIYSLEELFRHEFTHYLQGRYEVPGLWGQGELYQNERLTWFEEGNAEFFAGSTRVDSVVPRKSIIGGLSNDPAKRYTAEQTLNAKYGAWDFYNYSFALQSYMYNNRPDMFDKVHDLIRANDVPGYDAYRSALSKDNKLNEDYQSYMQMLINNRDKYTIPQVSDDYLAGHKLKALSEVAADITNEAKLKNVKVTKNKSQFFNTFTLQGTYTGSTSKGENEDWKAMNQATNEMLKHLSQKEWSGYKTLTAYFVNYRVNAAGQFEYDIVFNGVNTEEDTSVEKEPNNSFDTANPLSLNTLLRGSLNNQDQIDRFVIDIREAKDLQITVTNEQNLGLNWVLYHESDLNNYVTYATKYEGNKLLGSYYANPGKYYLSVYKYGSGTGNYTIEVK

SEQ ID NO: 28725 - protein, 330 aa, Bacillus pseudomycoides DSM 12442
MTQKKKTKTFVQTLALATTIVGGSLAFNASFVHADALPKVEDIGQGAKIMHSLDSTYNADANIKNSIKVSFIDDPNTDKKYAIVFTEGSNIASSFLRSPETPSAASLTWPSVFKTGLEITSNDNAKFYKVAPKNEIESKTVSSTVSYNVGGGLEIKPEGPSSSASAGASWSNTISYEQPDYKTFVTNNTDKKVDWNVEFNQFYNKGYGPYNRDSGGFYGNELFMNSRTDPLINAGDNFTSDSQLPALVRYGFQPSTMAIIIADKNATTTDLSVKHARENDVYLLTYNPIKGWTGENHKNSTYGNHGTIDNYKLDWKNNKIIHQSSGLQSN

SEQ ID NO: 28726 - protein, 823 aa, Bacillus pseudomycoides DSM 12442
MTWITKVSAETQEKTVKKQVSTKHVFQVMGKGNVDQIKDKDRRQFRFSPYEPTGLYASPNEKITILVEGTQNIQAYIGTFSYDAAWNQDSLIKSFTLKPGENTIESPNGGMIYFYNPQQGGTVRAEITAGGSPTPFFELGKHTQQDLVNMLDTYPNAHAVELKGERVLITASPERVKKYLIGSNTDPVQLLKKMDESIRIQDRVSGLSEKEADKHYVHFVEDNHSKDYYMYSYSSRTAYVGDAIQHVLDVNDFIKDGWGPWHEAGHQRQQTPWTWDGLGEVTVNIYSMSVQRAFGSKSRLEKGTYEKAFNYLNKPQSEKDYNKIDDLFVKLAMFWQLDLAFGEEFYPKLHQEYRSLSKEELPKNNEEKIQGFIYNTSKVAKQNLLPFFDKWGLVATPETRQKVEALNDPIITAPIWEATDSKPIKVKVEEPTITNQVSDTDEKDKTDVTLQKKNEDFIYNVKVTLPAEVAGYEALRIYDDIENVIDIEKVTVEDEKGTDISGYGEIKIDKATGKVEFNFAKDKITEVAGNNVFMKVTGKLKDEVDLSNYEKRTVSNTAKVQWNGKEKESNKVTVQVPLLKLGDRVWEDSNRNGIQDQGEKGIEGVRVLLLDKEGNVLKEIKTDKEGNYLFDGLTESIYRVQVEAPSGYVFTLKQSGQDVTVDSNVNEAGVTDDMAFSNDNLTFDLGITRNNNNGSSNNESSSNESSNNESSNNEPSNNESGNNEPSNNEPSNNESSNNEPSNNESGNNEPSNNEPSNNESDNNKTSNKSSNTENKPIDPTVKQMTNKNGVLPNTGSKISILGLIGVILLLISAILWKKSIKKI

SEQ ID NO: 28727 - protein, 175 aa, Bacillus pseudomycoides DSM 12442
MYKKMGTLVITGALAISLAGCSDTEETAKKVSNDTKTEQTTEKKEEKKKFKVGETIKLGNHKLTVTNVEKSPGGEFDKPKEGHEFLIANVTIENGGKEEIHYNAHDFSLQNSEGNIVDPTLTMINQDTQLNFGKLAQNGKITGTIAFESKQGDPKLQLIFKPISLSEEEVRVNLQ

SEQ ID NO: 28728 - protein, 41 aa, Bacillus pumilus
  Bacillus mesentericus
MTKITIPTALSAKVHGEGQHLFEPMAARCTCTTIISSSSTF

SEQ ID NO: 28729 - protein, 309 aa, Bacillus pumilus
  Bacillus mesentericus
MKKPELLVTPTSTADILPLIQAGATAFLVGEQRYGLRLAGEFSREDVTKAVEIAHKERAKVYVAVNAIFHNDKVGELGEYLAFLAEAGVDAAVFGDPAVLMAARESAPDLKLHWSTETTGTNYYTCNYWGRKGAARSVLARELNMDSIVEIKENAEVEIEIQVHGMTCMFQSKRSSIGNYFEYQGKVMDIERKKKESGMFLHDKERDNKYPIFEDENGTHIMSPDDVCIIDELEELIDAGIDSFKIDGVLKTPEYLIEVTKMYREAIDLCVENRDEYEAKKEDWIERIESIQPVNRKIDTGFFFKETVY

SEQ ID NO: 28730 - protein, 422 aa, Bacillus pumilus
  Bacillus mesentericus
MTAVNDKISTIVNGKRVITKKPELLAPAGNLEKLKIAVHYGADAVFIGGQEYGLRSNADNFTIEEIAEGVEFAKKYGAKIYVTTNIFAHNENMDGLEDYLKALGDANVAGIIVADPLIIETCRRVAPNVEVHLSTQQSLSNWKAVQFWKEEGLDRVVLARETSALEIREMKEKVDIEIESFIHGAMCIAYSGRCVLSNHMTARDSNRGGCCQSCRWDYDLYQTDGANAVALYGEEDAPFAMSPKDLKLIESIPKMIEMGIDSLKIEGRMKSIHYVATVVSVYRKVIDAYCADPENFVIQKEWLEELDKCANRDTATAFFEGTPGYEEQMFGEHAKKTTYDFVGLVLNYDEDTQMVTLQQRNFFKKGDEVEFFGPEIENFTHTIETIWDEDGNELDAARHPLQIVKFKLDKKIYPSNMMRKGK

SEQ ID NO: 28731 - protein, 275 aa, Bacillus pumilus
  Bacillus mesentericus
AQSVPYGISQIKAPALHSQGYTGSNVKVAVIDSGIDSSHPDLNVRGGASFVPSETNPYQDGSSHGTHVAGTIAALNNSIGVLGVAPSSALYAVKVLDSTGSGQYSWIINGIEWAISNNMDVINMSLGGPTGSTALKTVVDKAVSSGIVVAAAAGNEGSSGSTSTVGYPAKYPSTIAVGAVNSANQRASFSSAGSELDVMAPGVSIQSTLPGGTYGAYNGTSMATPHVAGAAALILSKHPTWTNAQVRDRLESTATYLGSSFYYGKGLINVQAAAQ

SEQ ID NO: 28732 - protein, 162 aa, Bacillus pumilus
  Bacillus mesentericus
MKKISSVFTMFALIAAILFSGFIPQQAYAETTLTPTATNKTASIQLTSDVHTLAVINTFDGVADYLIRYKRLPDNYITKSQASALGWVASKGNLAEVAPGKSIGGDVFSNREGRLPSASGRTWREADINYVSGFRNADRLVYSSDWLIYKTTDHYATFTRIR

SEQ ID NO: 28733 - protein, 300 aa, Bacillus pumilus
  Bacillus mesentericus
AAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNKGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 28734 - protein, 596 aa, Bacillus pumilus
  Bacillus mesentericus
MKKLFLNKKFLVFSFIFVMLLSLSFFNGESAKASSDKSYKMIGYYPSWGAYGRDFQVWDMDASKVSHINYAFADICWEGRHGNPDPTGPNSQTWSCQDENGVIDVPNGSIVMGDPWIDVQKSNPGDTWDEPIRGNFKQLLKLKKNHPHLKTFISVGGWTWSNRFSDVAADPAARENFAASAVDFLRKYGFDGVDLDWEYPVSGGLPGNSTRPEDQRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSDCESADNGEYQKCGPAKEGTWEKGVFDFSDLEKNYINKNGYKRYWNDRAKVPFLYNAENGNFITYDDEESYGYKTDFIQSNGLSGAMFWDFSGDSNQTLLNKLAADLGFAPGGSNPEPPSSAPDNLRVTEKTATSISLAWDVPSDGANISEYVLSYEGGSVSVKETSATIGKLKPNTTYSFTVSAKDADGKLHTGPTIEAATNSDQTCGYNEWKDTVVYTGGDRVVFNGKVYEAKWWTKGEQPDQAGESGVWKLIGDCK

SEQ ID NO: 28735 - protein, 659 aa, Bacillus pumilus
  Bacillus mesentericus
MLIFETYLILFKTVQITKRRIERRRLRLLNQCFTKKEGVSNREMASYNYVEVLQKSMLFYEAQRSGRLPESNRLNWRGDSGLKDGKDVGHDLTGGWYDAGDHVKFGLPMAYSAAVLAWTVYEYREAYEEAELLDEILDQIKWATDYFLKAHTGPNEFWAQVGDGNADHAWWGPAEVMPMNRPAFKIDEHCPGTEVAAQTAAALAAGSIIFKETDASYAAKLLTHAKQLYAFADRYRGKYTDCVTNAQPFYNSWSGYVDELIWGGIWLYLATNEETYLNKALKAVEEWPQDWDYTFTMSWDNTFFASQILLARITKENRFIESTERNLDYWTTGLVQNGKVERITYTPGGLAWLDQWGSLRYAANAAFLAFVYADWVSDQEKKNRYQSFAIKQTHYMLGDNPLNRSYVVGFGQNSPKHPHHRTAHGSWSNQLTNPPSHRHTLYGALVGGPNAQDQYDDDISDYISNEVATDYNAAFTGNIAKMVQLFGEGQSKLPNFPPKEQVEDEFFVEAAVMHNDTTSTQVKAVLYNRSGWPARSSQTLSFRYYVNLSEVFAKGFTEKDIQVTAAYNEGASLSPLKVYDASSRVYFAEIDFTGVVISPRGESEHKKEIQFRLSAPNGSNIWDASNDYSYQGLTSNMQKTTKIPVFEDGVLVFGTLPDK

SEQ ID NO: 28736 - protein, 346 aa, Bacillus pumilus
  strain SAFR-032
MNLKKISALLMISFVMIISAACQSSAKSSNADQKSTKKAEVKVDSYEYTLPEDSSTTLRDNELVLKVNLTITNKGDKALSLYSSDFSLYQDDAKVSDLKFYGSKDRLDLGSLNKGKSQSGALYFLVDKGKKYQFVYQDSIKKNSDSIEISLDGNKILDTAKKLDNPAKALSAYTDIIVFDKKNDQFADLTGDNQSDVVNKYHDMFVKDFKRTAGMYGNEVSDRDILSMYKRIQDTMKDKTKVETSVKTISNDEAKVVAQVTGIDATNLKDKLDKQRDEFYNGKIGSKEELYKKSLNLYASEFEKLPPVSSPTEYEVKMKRNGDGQWKIDLNDYNTSQYMSGFIKTR

SEQ ID NO: 28737 - protein, 352 aa, Bacillus pumilus
  strain SAFR-032
MFKKKLSLFLLILCVTVVAAACSGGKEKSAAKEKDTKSLDSAEVKVESAEYTLPPQYDTSVQDDQYVLKVNVSVKNISKEPLNVDKSNFTLYQDDSQVSTISPDDYNEVLSSSSLNAGKVSKGGLFFVVDKEKDYQLVYNEPGSGSKKDDKTLEFDIKGKDLMKKADTLQASAKALSSYIDVMIFGKNNDEFEKLTGDNKSTVVNQFDKSFKQGYITSSGISSSSAKDENLDKLLKAVKETLAEKSKVSTKTKAISGDKAVVTVTLTPIDASPLVDRLKEKATEFYSKNRSASYDEAQKYLLSIYPEEFKKLGPSSSEETVEVNMKKNDIDQWKLDLNDYKTSSLVEKFIKN

SEQ ID NO: 28738 - protein, 2047 aa, Bacillus pumilus
  strain SAFR-032
MKRILSLALIAVLVIQSSILGILPLAEAQAKESQENIYGDIEFVDSEGNKLSNIEDQQVRKAIVHWSIKGIDLKKQYPYVHTLPSAIQVEKEQKESITVDGIIVGEYTVSKQNEVTVIFKEDVELDPNLEGSIDIDVTSIAEQKEKTKQNEHEESLPKDDSTSSEKEDKNQEAAQTKQSNEEELLKNKVNVSKRVGLQSVSKQMQIQENLLTDAKLIFEDQEGNSVDKPDVNSLISINYEWAIPNGHSYNGGDEFHFKVPEELVIYEKIDRLEMKFNQATIGYFSVDESGNASIEFTDFIKQYSNIHGTLQVWTQLDKKTVITEEKEVVITPIEGKDKISIPIQYIPNGPNVSKKGEPNRSYNAETIQWTVDFNMDLDDVKQAKLLDPIQEGQALKKDSIKLYRVDTKLNGETSIGQLLDENHYTIGQTADGQDFTIEFKDDVHLAYRLMYETDITNQDQSAFRNKASLVSADKVISSAEGTVNVTRGSPLNKKAAQYDPVTQTITWEIRYNYNEKKIAEKDALLEDFFNGTQSLITDSFQVKEVTIDQNGKESGTKAFEDYVVQPQKKDEQNGFTLQFNQDIQSAYLITYQTKATERIFEAEDIINTVTAGKESKQGKQRIDQQILTKNHGTPNYKNKTIPWRIIFNKDQQTMNNVILKDTFTNEGLTLQKDSLKVTTGNTVLEEGTDYQIVEHANGFDIQFTKEIKTEHTITYTTSFDYEKRADKDQKNLRNHVKLEWVNEDGKDLTKENQSVFTPDTYTQSNGFKNGTYDAKKKEITWNIGVNYNLKHLEEAKIEDFIQGNQRLLKDSIIVYSLDLQGGENGAEEKEVLAKEHYDIKFLENEKGESGFEVIFKHAIDSPYKITYETSVEGMDLVQKTYENKATLYDGKTKESDVNAVVSIPNGGKYTSKSGNQQGKVIDWKLNINFGQSTVQDATIIDHPSSNQAIIENSFHLYSTTIDEKGQVTKKEELEKGKDYELDLEFDPDSFQIKFKEEITRPYILEYQSLILDKVGSTLQNEVTFRGENVKEIKKESEASIVVKRTAGMGDGTGAIGALTIKKVDASSGKALKGASFSLTDAASGIVIGTKTTDEEGALRFNRLLYGDYIVTEEKAPDGYIKTKEPINVTIDQPYESGDQTKTGNSMTVQNQEIRQHVQLTKKDKETGAVLENAEFELKNESGDTVQTHLKTDEKGEILFKHLEPGSYYFVETNAPKGYQLNQQKWPFTIKENQTETTIVTAVNDIIKGSAELSKIGEGGERLEGAQFKLLDQDGHELNGSLITGENGKITINELRPGTYQLIETKAPDGYVLDETPITFEVPLDPTEPVIISQKNLYETSALEVMKEGEDGKKLQGVRFEITDQNDKVVRKDLTTDEDGKLLVDNLKPGKYQLVETESIDGYQKKNKPYPFTIEIAQKKPTEIKVINDLKTGAVQLTKLGEKNEALEGAEFKLVDANGKEIKTGLVTDENGKIIINDLKPGTYQFVETKAPFGHELDETPVTFAMPFNPEKLVSVTKENSRTTGGVLLHKKGEDGKSLEGVVFDLSDAKGKIVAGGEGITTNQDGKITFTGLKPGTYQFVERKSLEGYELSEKPLVFEVDLGQKELIQVEAINQLKKGSVELTKIGEEKERLKGAEFTLFNDDGKELMSGLTTNEKGIITVNDLKPGAYQLVETKAPFGHKLDAQPVDFKIDFNPNQLVKVTKENVRMTSAVKLQKKGEDGQLLAGVTFDLIDAHDQRIKKDLKTDKNGQLTVDQLKPGTYQFIETASIAGYELDQTPVSFTIRLGQDKPAKVEMINKLTPGAVELTKVDDEGHTLEHAEFALLSKEGKTLKKSLVTDQKGKIHINDLKPGDYQFVETKAPHGYKLDDQPILFTIEKNQQKPLQVTAKNHLILGSLRIIKVDQQTDRTLKGAAFDIRTKAGKTIKSVTTEEDGEAIVKGLKPGEYTLTETKAPNGYVALKKPLAFTIQKGEVEIKTLIVKNAPMKNEVDHTNPPASDKGDQHPPHDSNSNGELPKTGEEWLRYMMYAGILLVASGTVLLVLRRRTIQ

SEQ ID NO: 28739 - protein, 1865 aa, Bacillus pumilus
  strain SAFR-032
MGNLYNQFDHKCPFCGKYHEEPHYKRSRHDRPQRRDCPYIKQEHSKQNRPQGDPSCAKGEKQPKIIQRVGRRGPAGPAGPTGPTGPAGGLIGALPFNPSQSQDYEAGQVVTFNGSTYIANVDAPSGIPGLSPDYTLLAASGETGPTGPTGIGLSGIEAYDPARASTYSIGQVVTYEGGTYIVDSAPPLGTPDTSPDYTLLAAPGVSGSTGVTGITGATGSTGATGSTGSTGPTGPTGATGITGSTGPTGVTGITGSTGSTGVTGSTGPTGSTGITGSTGSTGATGITGSTGSTGATGITGPTGPTGVTGITGATGTTGATGITGVTGSTGVTGITGATGPTGVTGITGTTGSTGSTGITGVTGPTGATGITGSTGSTGATGSTGPTGPTGSTGITGATGPTGATGITGITGSTGPTGATGITGSTGPTGATGITGATGPTGVTGITGATGPTGVTGITGTTGSTGSTGITGSTGPTGATGITGITGSTGPTGATGITGSTGPTGATGITGATGPTGVTGITGATGPTGVTGITGTTGSTGSTGITGSTGPTGATGITGATGSTGATGSTGPTGPTGATGITGATGPTGATGITGSTGPTGATGITGATGPTGATGITGATGTTGATGITGATGITGSIGPTGATGITGATGPTGATGITGATGPTGATGITGATGSTGATGITGSTGSTGATGITGATGPTGVTGITGSTGPTGVTGITGTTGSTGSTGITGVTGPTGATGITGSTGSTGATGSTGPTGPTGSTGITGATGPTGATGITGATGSTGVTGITGSTGTTGATGITGATGPTGVTGITGSTGTTGATGITGATGPTGVTGITGTTGSTGSTGITGVTGPTGATGITGSTGSTGATGSTGPTGPTGSTGITGATGPTGATGITGATGPTGVTGITGATGPTGATGITGATGTTGATGITGPTGPTGSTGITGATGPTGATGITGATGPTGATGITGATGTTGATGITGPTGPTGSTGITGATGPTGATGITGATGPTGATGITGATGPTGVTGITGATGPTGVTGITGATGPTGVTGITGTTGSTGSTGITGVTGPTGATGITGSTGSTGATGSTGPTGPTGSTGITGATGPTGATGITGATGPTGATGITGATGPTGVTGITGATGPTGATGITGATGSTGATGSTGPTGPTGSTGITGATGPTGATGITGATGPTGATGITGATGPTGATGITGATGSTGATGITGATGSTGATGSTGPTGPTGSTGITGATGPTGATGITGATGPTGVTGITGATGPTGATGITGATGPTGATGITGSTGPTGVTGITGTTGSTGSTGITGATGPTGATGITGATGPTGATGITGATGPTGATGITGATGPTGATGITGSTGPTGVTGITGATGSTGATGITGATGSTGATGITGATGSTGATGITGATGITGSTGPTGATGITGATGITGSTGPTGATGITGATGPTGATGITGATGSTGATGITGATGSTGATGITGATGITGSTGPTGATGITGSTGPTGATGITGSTGSTGATGTTGATGPTGATGITGATGPTGVTGITGSTGPTGATGITGATGPTGVTGITGATGPTGATGITGATGPTGVTGITGATGITGSTGPTGATGITGATGPTGVTGITGATGITGATGPTGVTGITGATGITGATGSTGATGITGSTGPTGATGITGATGATGATGSTGPTGPTGATGSTGATGPTGATGITGSTGPTGATGTGGFTDTALYAANSSGPTIVTVAGGTNIPLPNFQNITGFTANGTSTVFTVLQTGKYYITYQVNTTTALLISTRLLLNGATTISGSVQSPVISTSFINNTVIVNLTAGSTISLQFFGAVVTAILVGGGGAAGATLTIIRLS

SEQ ID NO: 28740 - protein, 430 aa, Bacillus pumilus
  strain SAFR-032
MPYIVDVYAREVLDSRGNPTVEVEVYTESGGFGRALVPSGASTGEYEAVELRDGDKDRYLGKGVLTAVNNVNEIIAPELLGFDVTEQVAIDKMLIELDGTENKGKLGANAILGVSIAVARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEDMVSKYPIISIEDGLDENDWEGHKLLTERLGSKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIETFYNLNK

SEQ ID NO: 28741 - protein, 917 aa, Bacillus pumilus ATCC 7061
MAFDPAVAPTYPAGQVVTFDGSTYLVNSASPTGTPGTSPDYTLLAAAGEAGATGATGTGATGATGDTGATGDTGATGVTGATGATGATGVGLTGIVAFDPATSPTYPVGQVVIFEGGTYVVNTASPTGTPDTSPDYTLLAAAGDTGATGATGVTGDTGATGATGVTGDTGVTGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGVTGDTGATGATGVTGVTGDTGATGATGVTGDTGVTGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGDTGATGATGVTGVTGDTGATGATGVTGDTGATGATGVTGDTGATGATGVTGDTGATGATGVTGDTGATGATGVTGDTGATGATGVTGVTGDTGATGATGVTGDTGATGATGVTGDTGATGATGVTGDTGATGATGVTGDTGATGATGVTGDTGATGATGVTGVTGDTGATGATGVTGDTGATGATGVTGDTGATGATGVTGVTGDTGATGATGVTGDTGATGATGVTGDTGATGATGVTGVTGDTGATGATGVRGATGTRIGTRASGNFGTQTVANDANFSFVNVVVAGLTYTAPGIFTIQEDGIYEIVAIVSAASAQAGPLVINVNVDGSNVVNGVVRGTTVGQQVTAIGLARLVPGTAIQLTNNSGQAITTDSGRITIFRLS

SEQ ID NO: 28742 - protein, 430 aa, Bacillus pumilus ATCC 7061
MPYIVDVYAREVLDSRGNPTVEVEVYTESGGFGRALVPSGASTGEYEAVELRDGDKDRYLGKGVLTAVNNVNEIIAPELLGFDVTEQVAIDKMLIELDGTENKGKLGANAILGVSIAVARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEDMVSKYPIISIEDGLDENDWEGHKLLTERLGSKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIATFYNLNK

SEQ ID NO: 28743 - protein, 903 aa, Bacillus pumilus ATCC 7061
MQGLFNISHKNKNVHTPFQGTMNTMDGGDSMRRCRQCGKTYPTHSTDHYQKGSWYDAYKDDGWECDSCKKGKSGKPVKNPCCGKDPCVCVIQGPPGGRGRRGPAGPAGAVGPAGPAGPIGPTGVGLTGIVAFDPAVAPTYPVGQVVTYDGSTYVVNTAPPTGTPDTSPDYTLLAAAGATGETGATGTGATGATGATGVTGATGEIGPTGATGTGVTGATGATGATGVTGATGEIGPTGATGTGVTGATGATGATGVTGATGEIGPTGVTGTGATGATGATGATGATGATGEIGPTGATGTGATGATGATGVTGATGEIGPTGATGITGATGLIGATGETGATGATGATGITGATGVTGDTGVTGATGATGVTGETGITGATGLTGTTGATGATGATGVTGETGITGATGLTGATGETGATGATGVTGDTGVTGATGVTGITGATGLTGATGETGATGATGVTGDTGVTGVTGATGITGATGVTGDTGATGVTGATGITGATGVTGDTGATGVTGATGITGATGVTGDTGVTGATGATGITGATGVTGDTGATGVTGATGITGATGVTGDTGVTGATGATGITGATGVTGETGITGATGLTGATGVTGATGATGVTGNTGATGVTGATGATGVTGDTGVTGVTGATGITGATGVTGDTGVTGVTGATGITGATGVTGDTGVTGATGATGVTGETGITGATGLTGATGATGATGATGLTGATGVTGATGATGVTGSSAIIPFASGDPVILTTIAGGLVGTSSLVGFGNSATGVSIVGGIIDLTGAAGTLLNMAFSVPRAGTITSFAGYFSTTAALSLIGTSITVTASLFASPTPNNSFTQVASVTLAPALTGVLTLGAIANGIATGLNVPVTPQTRLLVVFSATATGLSLLNTVAGYASAGLSIT

SEQ ID NO: 28744 - protein, 352 aa, Bacillus pumilus ATCC 7061
MFKKKLSLFLLILCVTVVAAACSGGKEKSAAKEKDTKSLDAAEVKVESAEYTLPPQYDTSVQDDQYVLKVNVSVKNISKEPLNVDKSNFTLYQDDSQVSTISPDDYNEVLSSSSLNADKVSKGGLFFVVDKDKDYQLVYNEPGSGSKKDDKTLEFDIKGKDLMKKADTLQASAKALSSYIDVMIFGKNNDEFEKLTGDNKSTVVNQFDKSFKQGYITSSGISSSSAKDENLDKLLKAVKETLAEKSKVSTKTKAISGDKAVVTVTLTPIDASPLVDRLKEKATEFYSKNRSASYDEAQKYLLSIYPEEFKKLGPSSSEETVEVNMKKNDIDQWKLDLNDYKTSSLVEKFIKN

SEQ ID NO: 28745 - protein, 346 aa, Bacillus pumilus ATCC 7061
MNLKKISALLMISFVMIISAACQSSAKSSNTDQKSTKTAEVKVDSYEYTLPEDSTTTLRDNELVLKINLTITNKGDKALSLYSSDFSLYQDDAKVSDLKFYGSKDRLDLGSLNKGKSQSGALYFLVDKGKKYQFVYQDSIKKNSDSIEIDLDGNKILDTAKKLDNPAKALSAYTDIIVFDKKNDQFADLTGDNQSDVVNKYHDMFVKDFKRSAGMYGNEVSDRDILSMYKRIQDTMKDKTKVETSVKTISNDEAKVVAQVTGIDASNLKDKLDKQRDEFYNGKIRSKEELYKKSLNLYASEFEKLPPVSSPAEYEVKMKRNGDGQWKIDLNDYNTSQYMSGFIKTR

SEQ ID NO: 28746 - protein, 2045 aa, Bacillus pumilus ATCC 7061
MKRILSLALIAVLVIQSSILGILPLAGAQAKESQENIYGDIEFADSEGNKLSNMEDQQVRKAIVHWSIKGIDLKKQYPYVLTLPSAIQVEKEQKEPITVGDILVGEYTVSKQNEVTVIFKEDVDLDPNLEGSINIDVTSIAEPKEKTKQNEREESLPKDDSTSSEKDDKNQEAAQTKQSDEDELLKNKVNVSKRVGLQSVSKQMLIQENLLTDAKLIFEDQEGNSVDKPDINSLISINYEWAIPNGHSYNGGDEFHFKVPEELVIYEKIDRLEMKFNQVTIGYFSVDESGNASIEFTDFIKQYSNIHGTLQVWTQLDQKTVITEEKEVVITPIEGKDTISIPIQYIPNGPNVSKKGEPNRSYNAETIQWTVDFNMDLDDVKQARLLDPIQEGQALKKDSIKLYRVDTKLNGETSLGQLLDENHYTIGQTADGQDFTIEFKDDVHLAYRLMYETDITNQDQSAFRNKASLVSADKVISSAEGTVNVTRGSPLNKKAAHYDPVTQTITWEIRYNYNEKKIAEKDALLEDFFNGTQALISDSIQVKEVTIDQDGKESGTKAFGNYVVQPQKKDEQNGFTLQFNQDIQSAYLITYQTKATERIFEAEEIINTVTAGKESKQGKQRIDQQILTKNHGTPNYKNKTIPWRITFNKDQQTMNNVILKDTFTNEGLTLQKDSLKVTTGNTVLEEGTDYQIVEHANGFDIQFMKEIKTEHTVTYTTSFDYEKRADKDQKNLRNHVKLEWVNEDGKDLTKENQSVFTPDTYTQSNGFKNGTYDAKKKEITWNIGVNYNLKHLEEAKIEDFIQGNQRLLKDSITVYSLDLQGGENGAEEKEVLAKEHYDIKFLENEKGESGFEVIFKHAIDSLYKITYQTSVEGMDLVQKTYENKATLFDGKTKESDVNAVVSIPNGGKYTSKSGNQQGKVIDWKLNINFGQSTVQDATIIDHPSSNQAIIENSFHLYSTTIDEKGQVTKKEELEKGKDYELDLEFDPDSFQIKFKEEITRPYILEYQSLILDKVGSTLQNEVTFRGENVKEIKKESEASIVVKRTAGMGDGTGAIGALTIKKVDASSGKALKGASFSLTDAASGIVIGTKTTDEEGALRFDRLLYGDYIVTEEKAPDGYIKTKEPINVTIDQPYESGDQAKTGNSMTVQNQEIRQHVQLTKKDKETGAVLENAEFELKNESGDTVQTHLKTDDKGEILFKHLEPGSYYFVETNAPKGYQLNQQKWPFTIKENQTETTIVTAVNDIIKGSAELSKIGEGGERLEGAQFKLLDQDGHELNGSLVTGENGKITINELRPGTYQLIETKAPDGYVLDETPIKFEVPLDPTEPVIISQKNLYETSALEVMKEGEDGKKLQGVRFEITDQNDEVVRKDLTTDKDGKLLVDNLKPGKYQLVETESIDGYQKKNKPYPFTIEIAQKTPAEIKVINDLKTGAVQLTKLGEKNEALEGAEFKLVDANGKEMKTGLVTDQNGEIIVNDLKPGTYQFVETKAPFGHELDETPVTFAIPFNPEKLVSVTKENSRTTGGVLLHKKGEEGKSLEGVVFDLSDAKGKIVAGGEGITTNQDGKITFTGLKPGTYQFVERKSLEGYELSAKPLVFEVELGQKEWIQVEAINQLKKGSVELTKIGEEKERLKGAEFTLFNDDGKELMSGLTTNEKGIITVHDLKPGAYQLVETKAPFGHKLDAEPVDFQIDFNPNQLVKVTKENVRMTSAVQLQKKGEDGQLLNGVTFDLLDEHDQRIKKDLKTDQNGQLTVDQLKPGTYQFVETASIAGYELDQTPVSFKIRLGQDKPAKVEMINKLTPGAVELTKVDDEGHTLENAEFALLSKEGKTLKKSLVTDQKGKLLINDLKPGEYQFVETKAPHGYQLDKQPILFTIEKNQQKPLQLTAKNHLILGSLRIIKVDQQTDRTLKGAAFDIRTKTGKTIKSVTTGKDGEAIVKGLKPGEYTLTETKAPNGYVALKKPLAFTIQMGEVEIKTLIVKNAPVKNEEDHTNPPASPKGDQHPPHDSNGELPKTGEEWLRYLMYAGILLAASGTVLLVVRRRTIQ

SEQ ID NO: 28747 - protein, 1952 aa, Bacillus selenitireducens
  strain ATCC 700615 / DSM 15326 / MLS10
MKYLQKQCVIGLVMALLFPLFIPFFESVSFADSSMQTARSGELLNNGSFEDQEHAGDFADLWTDGMKPAYWDLRNWGNSGGEPPLATHHHDEQIVTIELDQTVSFFQYQNPIPVKQDATYELTTAIRAENLSTPHTSGNAASLRVEHLNENGQVLLRDDVAHVTNTDQDTGWHDVHESVQPVQGAETIRLILITGVVSPGQGATGTIAIDSFSLSEVSKDEPPHVEDELANTLLKNHRFDETEHAESFADLWQDETKPAYWDLRNWGPSEGEAPKGHVHLEGEETIVSLSLDETVGFFQYYDAIEVDPNRRYEIGTVLRTAELNSPNPQGNAAFLRVEQFNGTSLLERKDVAAVPAGSTDWMTRTGEIETKSNATHIRLILVIGGAVSPEAGSSGTIDIKSFAISGQEAAVEGISFDDEPIYVKEGETVKATFGLTPVYAEADSFTWTTGDPTVATVDDGSITGVSAGETAVTVIVNDDLTLTDTAKVIVHDGEIPVSDITLQETDMTVVEGRSFAVFPDVHPSSSSDATLNWSVSDETVLQTDGTFVHAIAPGEAEVIIRAADSDAEARMTVSVLPYEETEFDRMRERWVNYIVPNAYTDMDTPAIADQVDELTEKAASLLATMKMDKEADVLWDDAGQFSDSATMTTHFRNLHQMAQAYTFEASSLYKSESLLEAILYGLRWMNEHHYHADGSDYGNWWDWQIGSPQLLNDTVAMVHDSLAEEQRLRYTDAVKHYIPEVTHYYGVGNATWRVKASGANLVDLGKAVALQGILAHDEERIASAQEHFPVVTIKQSGRGNGVYIDGSFIDHNNIAYTGTYGVVFLGSMIDLIYMLNDSRYELNEDDLNVIYEMIFLSFEPVIYKGLMMDMVNGRAISRGNTEDIGHGRGAVQRIIQYATIVPNHYEERMMSMIKGWLISQPEMIDAFNRIQVITMANTILNDETIEARGELIGHYLMTHMDRVAHRRPGFTFALSKYSDRIAAYEGNMNGENMKGHYTGSGMTYLYTDDLHQYNDGFWAAIDPKRLPGITANMDRPLSPGLGTARTSPATWVGGTSLDGLYGASGMQLDQAVFGQSLTGHKSWFMFDDEIVALGSGISSDDGDQIETIIDSRKLAKEGMNEILIDGAAINTGMNTSHTATEPTWMHIEGNTAGSDIGYVFPETADVHVQRYEQSGSWYDINRNGSTETVTRPFAELSVDHGTDPTDDTYAYIVLPNQSSEAVSDYAAAPDVTVLANTKEVQAAEEASLGILAANFWTDGPTTAGKLTSYNKASVMMREYPGDRLEVSVSDPTRQNNGTIELVIDHPVSAPLVLDDGVKVLAHTDENIHLSFDVKDASGLSKTAILDLQEGSSGWQTNALFDERFEDGPHGESVTSVNVSKADSLTYFHKSEAILPERDFTGVTPFAAETGTVEVTYTFTPKEEGIDAVMGLAGEEMTISNYPDLPIIVRASSNTGGLFDARDGAVFKADEELSWHVGTSYDIAISVNLDEGRYSVLVTPEDENPVQIASDFAFRDTASTPEDIGKFIFQDNRTTHASVVDNLKINGKEAGIINKYGKLESIDGEDAFTHLDVSDATDRIIVNWSFMTRETEGLTITVSDTDSAPLFTMENGMDRFVAGYWHDATLDINLLSGVYSFTLDGDVIESGSWAENAKAPARFTFGYDASSGTSDRQLFIDHFTLLETSVAITQLSAAESALHLNTGDEYLLSPVVEPAGAFTEGLRYTTDASDTVTVDHRGTVTAKQAGNAVITITDLVSGTSAQVRVSVTDLPSQQFEDVPLNHWASHYIDTLTSAGIIEGFSDYEFRPADDVTRGQMIAMLVRIGELNPSTPGETAFTDQHGTLSDAITAAYEAGITNGYEDGTFRQDESVNREEMAIMIARAIDIFTGEPLSSEHDLAYKDLEQIGQTAIPSVAALTKTGILEGTAGGHFLPHQPTKRDQTAKVLYYVKELID

SEQ ID NO: 28748 - protein, 428 aa, Bacillus selenitireducens
  strain ATCC 700615 / DSM 15326 / MLS10
MTVITDVYARQVLDSRGNPTVEVEVHTESGAFGRAIVPSGASTGEYEAVELRDGGDAWMGKGVTKAVENVNEIIAPELVGYDALDQLGIDQLMIDLDGTPNKAKLGANAILGVSMATARAAADALGLPLYVYLGGFNAKTLPTPMMNILNGGEHADNNVDIQEFMVMPVGAESFTEALQMGAEIFHNLKKVLSSKGYNTAVGDEGGFAPNLKSNEEALSTIIEAIEKAGYKPGEQVQLAMDAAASEIYEDGKYHLKGEGRVLTSQEMVDFYAELCDKYPIISIEDGLDENDWEGFKLMTERLGDKVQIVGDDLFVTNTDKLSRGIQEGIGNSILIKVNQIGTLSETFEAIEMAKRAGYTNVISHRSGETEDSTIADIAVATNAGQIKTGAPSRTDRVAKYNQLLRIEDELQYIGQYAGKAAFYNLNNK

SEQ ID NO: 28749 - protein, 430 aa, Bacillus smithii 7_3_47FAA
MPFITEVYAREVLDSRGNPTVEVEVYTESGAFGRALVPSGASTGEYEAVELRDGDKSRYLGKGVLTAVKNVNEIIAPELIGHDVTDQVGIDKLLIELDGTENKGKLGANAILGVSMAVARAAADFLGVELYQYLGGFNAKQLPVPMMNILNGGAHADNNVDIQEFMIMPVGASNFREALRMGAEIFHNLKSVLKEKGYNTAVGDEGGFAPNLKSNEEALQTIIEAIEKAGYKPGEEVKLAMDVASSELYSDEDGKYHLDGEGVAKTSEEMVDWYEELISKYPIISIEDGLDENDWEGHKMLTERLGKKVQLVGDDLFVTNTKKLAQGIEKGVGNSILIKVNQIGTLTETFDAIEMAKRAGYTAVVSHRSGETEDSTIADIAVATNAGQIKTGAPSRTDRVAKYNQLLRIEDKLGDTAQYLGLKAFYNLKH

SEQ ID NO: 28750 - protein, 111 aa, Bacillus smithii 7_3_47FAA
MLAKIGCSEKGKGHGSVSLELHELGHSVDRYIYNDPFGDLRFRAVWKKEAPVLFPHQSYFIDYQEEYFAETFAMYYLNSQTKAYLRQHAPETYQYFVDMEKSHFYVADISV

SEQ ID NO: 28751 - protein, 341 aa, Bacillus sp.; identical to SEQ ID NO: 28569

SEQ ID NO: 28752 - protein, 251 aa, Bacillus sp.
MEIKQMLVPVSRYSVLCPYEMNPTEITFHNTYNDAPAINERNNVANNSTGTSFHIAVDDKEAIQLIPFNRNAWHAGDGTNGRGNRHSIGVEICYSQSGGARYRKAELNAVEVIAQLMIQFDIPISKVKTHQERNGKYCPHRMLDEGRVQWFKNQCANRASSIKNSNKTQETGKVEIIVNKFNKVVTYEFGTALVPEMLGMMDALGYESRIISYGDKQGLVRFETAYRQGNELDKATAWLDAKGLKYFYTKE

SEQ ID NO: 28753 - protein, 389 aa, Bacillus sp.
MKKITTIFVVLLMTVALFSIGNTTAADNDSVVEEHGQLSISNGELVNERGEQVQLKGMSSHGLQWYGQFVNYESMKWLRDDWGITVFRAAMYTSSGGYIDDPSVKEKVKEAVEAAIDLDIYVIIDWHILSDNDPNIYKEEAKDFFDEMSELYGDYPNVIYEIANEPNGSDVTWDNRIKPYAEEVIPVIRNNDPNNIIIVGTGTWSQDVHHAADNQLADPNVMYAFHFYAGTHGQNLRDQVDYALDQGAAIFVSEWGTSAATGDGGVFLDEAQEWIDFMDERNLSWANWSLTHKDESSAALMPGANPTGGWTEAELSPSGTFVREKIRESASIPPSDPTPPSDPGEYPAWDPTQIYTNEIVYHNGQLWQAKWWTQNQEPGDPYGPWEPLN

SEQ ID NO: 28754 - protein, 416 aa, Bacillus sp.
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSEVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLRP

SEQ ID NO: 28755 - protein, 224 aa, Bacillus sp.
MKKLLGLILSAALTLSLYGLEPQVAEAAPTVVHETIRVPAGQTFDGKGQTYVANPNTLGDGSQAENQKPIFRLEAGASLKNVVIGAPAADGVHCYGDCTITNVIWEDVGEDALTLKSSGTVNISGGAAYKAYDKVFQINAAGTINIRNFRADDIGKLVRQNGGTTYKVVMNVENCNISRVKDAILRTDSSTSTGRIVNTRYSNVPTLFKGFKSGNTTASGNTQY

SEQ ID NO: 28756 - protein, 713 aa, Bacillus sp.
  strain 1011
MKRFMKLTAVWTLWLSLTLGLLSPVHAAPDTSVSNKQNFSTDVIYQIFTDRFSDGNPANNPTGAAFDGSCTNLRLYCGGDWQGIINKINDGYLTGMGITAIWISQPVENIYSVINYSGVNNTAYHGYWARDFKKTNPAYGTMQDFKNLIDTAHAHNIKVIIDFAPNHTSPASSDDPSFAENGRLYDNGNLLGGYTNDTQNLFHHYGGTDFSTIENGIYKNLYDLADLNHNNSSVDVYLKDAIKMWLDLGVDGIRVDAVKHMPFGWQKSFMATINNYKPVFTFGEWFLGVNEISPEYHQFANESGMSLLDFRFAQKARQVFRDNTDNMYGLKAMLEGSEVDYAQVNDQVTFIDNHDMERFHTSNGDRRKLEQALAFTLTSRGVPAIYYGSEQYMSGGNDPDNRARLPSFSTTTTAYQVIQKLAPLRKSNPAIAYGSTHERWINNDVIIYERKFGNNVAVVAINRNMNTPASITGLVTSLRRASYNDVLGGILNGNTLTVGAGGAASNFTLAPGGTAVWQYTTDATTPIIGNVGPMMAKPGVTITIDGRGFGSGKGTVYFGTTAVTGADIVAWEDTQIQVKIPAVPGGIYDIRVANAAGAASNIYDNFEVLTGDQVTVRFVINNATTALGQNVFLTGNVSELGNWDPNNAIGPMYNQVVYQYPTWYYDVSVPAGQTIEFKFLKKQGSTVTWEGGANRTFTTPTSGTATVNVNWQP

SEQ ID NO: 28757 - protein, 703 aa, Bacillus sp.
  strain 1-1
MNDLNDFLKTILLSFIFFLLLSLPTVAEADVTNKVNYSKDVIYQIVTDRFSDGNPGNNPSGAIFSQNCIDLHKYCGGDWQGIIDKINDGYLTDLGITALWISQPVENVYALHPSGYTSYHGYWARDYKKTNPYYGNFDDFDRLMSTAHSNGIKVIMDFTPNHSSPALETNPNYVENGAIYDNGALLGNYSNDQQNLFHHNGGTDFSSYEDSIYRNLYDLADYDLNNTVMDQYLKESIKFWLDKGIDGIRVDAVKHMSEGWQTSLMSEIYSHKPVFTFGEWFLGSGEVDPQNHHFANESGMSLLDFQFGQTIRNVLKDRTSNWYDFNEMITSTEKEYNEVIDQVTFIDNHDMSRFSVGSSSNRQTDMALAVLLTSRGVPTIYYGTEQYVTGGNDPENRKPLKTFDRSTNSYQIISKLASLRQTNSALGYGTTTERWLNEDIYIYERTFGNSIVLTAVNSSNSNQTITNLNTSLPQGNYTDELQQRLDGNTITVNANGAVNSFQLRANSVAVWQVSNPSTSPLIGQVGPMMGKAGNTITVSGEGFGDERGSVLFDSTSSEIISWSNTKISVKVPNVAGGYYDLSVVTAANIKSPTYKEFEVLSGNQVSVRFGVNNATTSPGTNLYIVGNVNELGNWDADKAIGPMFNQVMYQYPTWYYDISVPAGKNLEYKYIKKDQNGNVVWQSGNNRTYTSPTTGTDTVMINW

SEQ ID NO: 28758 - protein, 713 aa, Bacillus sp.
  strain 17-1
MKKISKLTTALALSLSLALSLLGPAHAAPDTSVSNKQNFSTDVIYQIFTDRFSDGNPANNPTGPAFDGTCTNLRLYCGGDWQGIINKINDGYLTGMGVTAIWISQPVENIYSVINYSGVNNTAYHGYWARDFKKTNPAYGTIADFQNLIAAAHAKNIKVIIDFAPNHTSPASLDQPSFAENGKLYNNGRDEGGYTNDTHNLFHHNGGTDFSTTENGIYKNLYDLADLNHNNSTVDTYLKDAIKMWLDLGIDGIRMDAVKHMPFGWQKSFMATVNNYKPVFTFGEWFLGVNEVSAENHKFANVSGMSLLDFRFAQKVRQVFKDNTDNMYGLKSMLEGSATDYAQMEDQVTFIDNHDMERFHNNSANRRKLEQALAFTLTSRGVPAIYYGTEQYMSGGNDPDNRARIPSFSTTTTAYQVSKKLAPLRKSNPAIAYGTTQERWINNDVLIYERKFGNNVAVIAVNRNVNTSASITGLVTSLPAGSYTDVLGGLLNGNNLTVGSGGSASIFTLAAGGTAVWQYTTAVTAPTIGHVGPMMAKPGAAVTIDGRGFGATKGTVYFGTTAVTGANITAWEDTQIKVKIPAVAGGVYNIKIANSAGTSSNVHDNFEVLSGDQVSVRFVVNNATTALGQNVYLAGSVSELGNWDPAKAIGPLYNQVIYQYPTWYYDVTVPAGKTIEFKFLKKQGSTVTWEGGSNHTFTAPTSGTATINVNWQP

SEQ ID NO: 28759 - protein, 712 aa, Bacillus sp.
  strain 38-2
MKRFMKLTAVWTLWLSLTLGLLSPVHAAPDTSVSNKQNFSTDVIYQIFTDRFSDGNPANNPTGAAFDGSCTNLRLYCGGDWQGIINKINDGYLTGMGITAIWISQPVENIYSVINYSGVHNTAYHGYWARDFKKTNPAYGTMQDFKNLIDTAHAHNIKVIIDFAPNHTSPASSDDPSFAENGRLYDNGNLLGGYTNDTQNLFHHYGGTDFSTIENGIYKNLYDLADLNHNNSSVDVYLKDAIKMWLDLGVDGIRVDAVKHMPFGWQKSFMSTINNYKPVFNFGEWFLGVNEISPEYHQFANESGMSLLDFPFAQKARQVFRDNTDNMYGLKAMLEGSEVDYAQVNDQVTFIDNHDMERFHTSNGDRRKLEQALAFTLTSRGVPAIYYGSEQYMSGGNDPDNRARIPSFSTTTTAYQVIQKLAPLRKSNPAIAYGSTQERWINNDVIIYERKFGNNVAVVAINRNMNTPASITGLVTSLPQGSYNDVLGGILNGNTLTVGAGGAASNFTLAPGGTAVWQYTTDATAPINGNVGPMMAKAGVTITIDGRASARQGTVYFGTTAVTGADIVAWEDTQIQVKILRVPGGIYDIRVANAAGAASNIYDNFEVLTGDQVTVRFVINNATTALGQNVFLTGNVSELGNWDPNNAIGPMYNQVVYQYPTWYYDVSVPAGQTIEFKFLKKQGSTVTWEGGANRTFTTPTSGTATVNVNWQP

SEQ ID NO: 28760 - protein, 718 aa, Bacillus sp.
  strain 6.6.3
MFQMAKRAFLSTTLTLGLLAGSALPFLPASAAYADPDIAVTNKQSFSTDVIYQVFTDRFLDGNPSNNPTGAAYDATCSNLKLYCGGDWQGLINKINDNYFSDLGVTALWISQPVENIFATINYSGVTNTAYHGYWARDFKKTNPYFGTMADFQNLITTAHAKGIKIIIDFAPNHTSPAMETDTSFAENGKLYDNGTLVGGYTNDTNGYFHHNGGSDFSSLENGIYKNLYDLADFNHNNATIDKYFKDAIKLWLDMGVDGIRVDAVKHIALGWQKSWMSSIYVHKPVFTFGEWFLGSAASDADNTDFANKSGMSLLDFRFNSAVRNVFRDNTSNMYALDSMINSTATDYNQVNDQVTFIDNHDMDRFKTSAVNNRRLEQALAFTLTSRGVPAIYYGTEQYLTGNGDPDNRAKMPSFSKSTTAFNVISKLAPLRKSNPAIAYGSTQQRWINNDVYVYERKFGKSVAVVAVNRNLSTPANITGLSTSLPTGSYTDVLGGVLNGNNITSSNGSVNSFTLAAGATAVWQYTAAETTPTIGHVGPVMGKPGNVVTIDGRGFGSTKGTVYFGTTAVTGAAITSWEDTQIKVTIPSVAAGNYAVKVAANGVNSNAYNHFTILTGDQVTVRFVINNASTTLGQNIYLTGNVAELGNWSTGSTAIGPAFNQVIHQYPTWYYDVSVPAGKELEFKFFKKNGSTITWEGGSNHKFTTPASGTATVTVNWQ

SEQ ID NO: 28761 - protein, 518 aa, Bacillus sp. [sequence omitted]

SEQ ID NO: 28762 - protein, 401 aa, Bacillus sp.
  strain AK1
MKFKAIVSLSLAVSMSLFPFLVEAASNDGVESPKTVSEINVSHEKGAYVQGEVIVQFKEQVNAEEKAKALKEVGATAVPDNDRVKSKFNVLKVGNVEAVVKALNNNPLVEYAEPNYLFNAAWTPNDTYYQGYQYGPQNTYTDYAWDVTKGSSGQEIAVIDTGVDYTHPDLDGKVIKGYDFVDNDYDPMDLNNHGTHVAGIAAAETNNATGIAGMAPNTRILAVRALDRNGSGTLSDIADAIIYAADSGAEVINLSLGCDCHTTTLENAVNYAWNKGSVVVAAAGNNGSSTTFEPASYENVIAVGAVDQYDRLASFSNYGTWVDVVAPGVDIVSTITGNRYAYMSGTSMASPHVAGLAALLASQGRNNIEIRQAIEQTADKISGTGTYFKYGRINSYNAVTY

SEQ ID NO: 28763 - protein, 713 aa, Bacillus sp.
  strain B1018
MKKFLKMTAAFSLGLSLAFGLFSPAQAAPDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTSDVYLKDAIKMWLDLGIDGIRMDAVKHMPFGWQKSFMAAVNNYKPVFTFGEWFLGVNEVGPENHKFANESGMSLLDFRFAQKVRQVFRDNTDNMYGLKAMLEGSAADYAQVDDQVTFIDNHDMERFHASNANRRKLEQALAFTLILARVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLTVGSGGAASNFTLAAGGTAVWQYTAATATPTIGHVGPMMAKPGVTITIDGRGFGSSKGTVYFGTTAVSGANITSWEDTQIKVKIPAVAGGIYNIKVANAAGTASNVYDNFEVLSGDQVSVRFVVNNATTALGQNLYLTGNVSELGNWDPAKAIGPMYNQVVYQYPNWYYDVSVPAGKTIEFKFLKKQGSTVTWEGGSNHTFTAPSSGTATINVNWQP

SEQ ID NO: 28764 - protein, 383 aa, Bacillus sp.
  strain DS11
MNHSKTLLLTAAAGLMLTCGAVSSQAKHKLSDPYHFTVNAAAETEPVDTAGDAADDPAIWLDPKNPQNSKLITTNKKSGLAVYSLEGKMLHSYHTGKLNNVDIRYDFPLNGKKVDIAAASNRSEGKNTIEIYAIDGKNGTLQSITDPNRPIASAIDEVYGFSLYHSQKTGKYYAMVTGKEGEFEQYELNADKNGYISGKKVRAFKMNSQTEGMAADDEYGSLYIAEEDEAIWKFSAEPDGGSNGTVIDRADGRHLTPDIEGLTIYYAADGKGYLLASSQGNSSYAIYERQGQNKYVADFQITDGPETDGTSDTDGIDVLGFGLGPEYPFGLFVAQDGENIDHGQKANQNFKMVPWERIADKIGFHPQVNKQVDPRKMTDRSGK

SEQ ID NO: 28765 - protein, 546 aa, Bacillus sp.
  strain EA1
MDKRAMLGAIGLAFGLMAWPFGASAKEKSMVWNEQWKTPSFVSGSLLKGEDAPEELVYRYLDQEKNTFQLGGQARERLSLIGKQTDELGHTVMRFEQRYRGIPVYGAVLVAHVNDGELSSLSGTLIPNLDKRTLKTEAAISIQQAEMIAKQDVADAVTKERPAAEEGKPTRLVIYPDGETPRLAYEVNVRFLTPVPGNWIYMIDAADGKVLNKWNQMDEAKPGGGQPVAGTSTVGVGRGVLGDQKYINTTYSSYYGYYYLQDNTRGSGIFTYDGRNRTVLPGSLWADVDNQFFASYDAAAVDAHYYAGVVYDYYKNVHGRLSYDGSNAAIRSTVHYGRGYNNAFWNGSQMVYGDGDGQTFLPFSGGIDVVGHELTHAVTDYTAGLVYQNESGAINEAMSDIFGTLVEFYANRNPDWEIGEDIYTPGIAGDALRSMSDPAKYGDPDHYSKRYTGTQDNGGVHTNSGIINKAAYLLSQGGVHYGVSVTGIGRDKMGKIFYRALVYYLTPTSNFSQLRAACVQAAADLYGSTSQEVNSVKQAFNAVGVY

SEQ ID NO: 28766 - protein, 930 aa, Bacillus sp.
  strain GL1
MLSGILIAALLMTLWGGWQPDIAHASDEFDALRIKWATLLTGGPALDPADSDIAARTDKLAQDANDYWEDMDLSSSRTYIWYALRGNGTSDNVNAVYERLRTMALAATTVGSSLYGNADLKEDILDALDWLYVNSYNSTRSRSAYNWWHWQLGIPMSLNDIAVLLYDDISAARMATYMDTIDYFTPSIGLTGANRAWQAIVVGVRAVIVKDAVKLAAARNGLSGTGIFPYATGGDGFYADGSFVQHTTFAYTGGYGSSVLETTANLMYLLSGSTWSVSDPNQSNVWQWIYEAYRPLLYKGAMMDMVRGREISRSYAQDHAVGHGIVASIVRLAQFAPAPHAAAFKQIAKRVIQEDTFSSFYGDVSTDTIRLAKAIVDDPSIAPAAAPNLYKQYAAMDRAVLQRPGFALGLALYSTRISSYESINSENGRGWYTGAGATYLYNQDLAQYSEDYWPTVDAYRIPGTTVASGTPIASGTGTSSWTGGVSLAGQYGASGMDLSYGAYNLSARKSWFMFDDEIVALGSGISSTAGIPIETVVDNRKLNGAGDNAWTANGAALSTGLGVAQTLTGVNWVHLAGNTADGSDIGYYFPGGATLQTKREARTGTWKQINNRPATPSTAVTRNYETMWIDHGTNPSGASYGYVLLPNKTSAQVGAYAADPAIEIVVNTSGVQSVKEKTLGLVGANFWTDTTQTADLITSNKKASVMTREIADERLEASVSDPTQANNGTIAIELARSAEGYSADPGITVTQLAPTIKFTVNVNGAKGKSFHASFQLGEDTSGPVDPGEPELPSVIVDNADSAGVTRTGTWKTASTQTDRYGANYLHDDNAGKGTKSVTFTPNLPIAGSYEVYLMWPAHFNREDAVQVDVGHASGTTRTAVDQRSGGGVWHSIGTYEFLAGSGGSVTIRNDALGSPDGYVVADAVKFVAVG

SEQ ID NO: 28767 - protein, 636 aa, Bacillus sp.
  strain KSM-522
MTRRWSFLVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFLSQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGPLVGGPNRQDQYTDDISDYVSNEVATDYNAAFTGNGAAVWSGQSKLPNFPPKEKVEDEFFVEAAVMSNDTTSTQIKAILYNRSGWPARSSQSLSFRYYVNLSEIFAKGFTDKDIQVTAVYNEGASLSPLTVYDASSHIYFTEIDFTGVAIFPGGESLHKKEIQFRLSAPNGANIWDASNDYSFQGLTSNMQKTARIPVFDQGDLVFGTLPNK

SEQ ID NO: 28768 - protein, 921 aa, Bacillus sp.
  strain L7
MMKWFAKLILSLSLAVVMAASSAAISFGASNSSLDTHASLVTQLDSAASEAAEGKSAMINESAINSNVTGWKLHGKGRMEVTGEGLRLTSDPQENVMAISETVADDFIYEADVMVTDPQADATLLFRSGEDGWSSYMLQLALGAGVIRLKDASGGEGVLNVERKVEAKPGDIYHLRVKAEGTRLQVYWGQQYEPVIDTEAAAHRTGRLGLHVWNGSALFQNIRVSDMSGNTLEPISSQGLWQPDLKGLKGTGEDGLEAKKVFRNHEADVVLEGDLILNGQGSAGLLFRSNAQGTEGYAAVLQGEGERVRVYLKKADGTILHESRVTYPSQRESRHHLEVKAIGERIQIFVDGYEPAAIDMVDTAFPSGYHGVMASSGIAYFQDVYITPYASYYTEKYRPQYHYSPIRGSASDPNGLVYFEGEYHLFHQDGGQWAHAVSRDLIHWKRLPIALPWNDLGHVWSGSAVADTTNASGLFGSSGGKGLIAYYTSYNPDRHNGNQKIGLAYSTDRGRTWKYSEEHPVVIENPGKTGEDPGGWDFRDPKVVRDEANNRWVMVVSGGDHIRLFTSTNLLNWTLTDQFGYGAYIRGGVWECPDLFQLPVEGSKKRKWVLMISTGANPNTQGSDAEYFIGDLTPEGKFINDNPAGTVLKTDWGKEYYASMSFSDMPDGRRIMLAWMTNWDYPFSFPTTGWKGQLSIPRQVSLKETEEGIRMHQTPIEELAQLRSPVLTSPTARWGTSGENLLKGITSGAYEIEAELELPPTGAASEFGFRLREGDGQRTLVGYRAAGSKMFVDRSASGMTDFSDLFSTLHEAPLKPEGNRIKLRILVDESSVEVFGNDGRVVFSDVIFPDPASRGMSFYSEGGKVKVVSLQVHALQHIWREDEAKEPRVVMDTETLELSLGQTKPLFASIDNGQGKGADGI

SEQ ID NO: 28769 - protein, 409 aa, Bacillus sp.
  strain N-4 / JCM 9156
MKKITTIFVVLLMTLALFIIGNTTAADDYSVVEEHGQLSISNGELVNDRGEPVQLKGMSSHGLQWYGQFVNYESMKWLRDDWGITVFRAAMYTSSGGYIEDPSVKEKVKEAVEAAIDLGIYVIIDWHILSDNDPNIYKEEAKDFFDEMSELYGDYPNVIYEIANEPNGSDVTWDNQIKPYAEEVIPVIRNNDPNNIIIVGTGTWSQDVHHAADNQLTDPNVMYAFHFYAGTHGQNLRDQVDYALDQGAAIFVSEWGTSEATGDGGVFLDEAQVWIDFMDERNLSWANWSLTHKDESSAALMPGASPTGGWTEAELSPSGTFVREKIRESATTPPSDPTPPSDPDPGEPEPDPGEPDPTPPSDPGDYPAWDPNTIYTDEIVYHNGQLWQAKWWTQNQEPGDPYGPWEPLN

SEQ ID NO: 28770 - protein, 488 aa, Bacillus sp.; identical to SEQ ID NO: 26345
  strain N-4 / JCM 9156

SEQ ID NO: 28771 - protein, 420 aa, Bacillus sp.
  strain TA39
MKRSGKIFTTAMLAVTLMMPAMGVSANEGNAAAEGNEKFRVLVDSVDQKNLKNAKQQYGVHWDFAGEGFTTDMNEKQFNALKKNKNLTVEKVPELEIATATDKPEALYNAMAASQSTPWGIKAIYNNSSITQTSGGGGINIAVLDTGVNTNHPDLRNNVEQCKDFTVGTTYTNNSCTDRQGHGTHVAGSALADGGTGNGVYGVAPDADLWAYKVLGDDGSGYADDIAAAIRHAGDQATALNTKVVINMSLGSSGESSLITNAVNYSYNKGVLIIAAAGNSGPYQGSIGYPGALVNAVAVAALENKVENGTYRVADFSSRGYSWTDGDYAIQKGDVEISAPGAAIYSTWFDGGYATISGTSMASPHAAGLAAKIWAQYPSASNVDVRGELQYRAYENDILSGYYAGYGDDFASGFGFATVQ

SEQ ID NO: 28772 - protein, 378 aa, Bacillus sp.
  strain YaB
MNKKMGKIVAGTALIISVAFSSSIAQAAEEAKEKYLIGFKEQEVMSQFVDQIDGDEYSISSQAEDVEIDLLHEFDFIPVLSVELDPEDVDALELDPAIAYIEEDAEVTTMQTVPWGINRVQAPIAQSRGFTGTGVRVAVLDTGISNHADLRIRGGASFVPGEPNISDGNGHGTQVAGTIAALNNSIGVLGVAPNVDLYGVKVLGASGSGSISGIAQGLQWAANNGMHIANMSLGSSAGSATMEQAVNQATASGVLVVAASGNSGAGNVGFPARYANAMAVGATDQNNNRATFSQYGAGLDIVAPGVGVQSTVPGNGYASFNGTSMATPHVAGVAALVKQKNPSWSNVQIRNHLKNTATNLGNTTQFGSGLVNAEAATR

SEQ ID NO: 28773 - protein, 431 aa, Bacillus sp. 1NLA3E
MPFIQEVYAREVLDSRGNPTVEVEVLTESGSFGRALVPSGASTGEYEAVELRDGDKSRYLGKGVLKAVSNVNDIIAEAVIGMDVTDQVGIDRTMIELDGTENKGKLGANAILGVSMACAHAAADLVGLPLYRYLGGFNAKQLPTPMMNIINGGSHADNNVDFQEFMILPVGAPSFKEAIRMGAEVFHSLKKVLSGKGLNTAVGDEGGFAPNLGSNREALEVIIEAIKAAGYEPGKDIFLGMDVASSEFFNKKTGKYDLAGEGRTGLTSEEMVTFYEELVNEFPILSIEDGLDENDWEGHKLLTDRIGSRVQLVGDDLFVTNTKKLAEGIEKGISNSILIKVNQIGTLTETFEAIEMAKRAGYTAVVSHRSGETEDATIADIAVATNAGQIKTGSMSRTDRIAKYNQLLRIEDDLGELAVYDGLKSFYNLKK

SEQ ID NO: 28774 - protein, 451 aa, Bacillus sp. 1NLA3E
MKRRLSFLSLVTIILLMLIPLTLSTKAEEEVTKNDNPTDVVSNEILDDVPSDSTNDAVNDGSVPTIGDDSATETIETDNTSVTTEEQTIDAAQDGGTDSSPATVNNTEIEAKDETISASKTSTVMDNNGDDIDTSENTTATDVVPNVDNTDSTNTATEEDSAEGDTITDEAYLVENQISDEYQKEDGSLELDYSDAKNQSWFDVYLDTTLLGGLLEANPDQVLQINKGDVSVTLPLAILPTDQNFSFGLFRDPKTEGYLSPLYDFYIIQDDELLISEFESPVTLKFVIDPSLVKDWKNLRVVFIDDEGTNKEFITPIKYDKTTGEVWANVNHFSPYAVVEASSSNNSSIDSGSSDNGSSNNGSTNNSTINTGTINTGSNVTGTGTTNTSTATATTAIATKTSSTSASKNSTTSSIELPNTATNSFNILLAGLALIAIGGTVMFIKRRRVVK

SEQ ID NO: 28775 - protein, 1529 aa, Bacillus sp. 2_A_57_CT2
MMKRKFSIIFMTIMLLINGLVSSTLGYVQAEEQVQPAEGEINGTENEAGIDEATIDPAETIPVPEQRETSAADEKKTESPPEAEKESGISEENASPEESVNKDIQTEESPQSEQLESDAETGLNSEDASGEESKYVSGEETDVEKQVITENILTDVVLKDGAGKNIEDIRVDQGSKVRIEYQWSIPAGHDYSGGAVFTFTLPDKFKTDRLLTGNLDGGAGTYEVSSNGAVTFIFNETIDDGTGLTGNFYVEREFDMGKFSGSTKQEVQFPIKGTEKVILVHFKNNKSEMDKTGAANKVINPSEIKWVVDFNLGENKMNSTLFKDTLPDGLEIDMDSIEVYQLNVNLDGSVIAGNLLNNYTPIKTADGFEIPFNEIDSAYRVKYSTKITGTADKTFTNEATVSSTDLSDIKQTANVPVKFSQPLGKSSIAYDSSNQTITWAIQYNYNEQEILSEDAWIKDTFDTDHQVLVDSSFEVYTMTIKEDGSASKSGTPLEKGIDYTVVPDVSGFKLQFKNDVATAYEITYQTKAINRVHEDSYSVTNKAEIYDGTSESATRNIKQVIFQKNSANVDYNQKTIEWNILLNDDNKKMDQVTITDSFEGQNLKLIEDSLIIEGLEPEDYTLVPNFNYGEGFKIFFNNSITGSHLIKYKTIFDPRKPIPNGGYKNSATLNWFEEGVQQSPITKSAKIAPDSYTNKNGNKTGVYNARTKEITWTIDVNYNLHEIKDALIRDFYSGEQTLVEDSLKVHHLRLNGGPDGVSLGEEKTDFSMEVKEDPEGKDGFEIKLGTINTAYRITYKTSLKGLPVDASYSNNAILQDGDGGTPIFKQSVSVLPKHGGEYIQKNGTQGTGADLEFSLWSVHINRSQSYLKAASVLSDTLSENQILIQDSINLYKTAVSENGTLTKANLEDPSKYTLAVSGNTIQLTFNDEVEESYVLEYKAFINADHGEEVSNKVQFAGKSTGDVQRSDNEKFAVSFSEAGGGAFPSGKGNFKVVKTDADTNMPLAGAIFGLYDKSGTALLEKLETDEKGEAEFKAYKYKSYKLKELTPPVGFVISDEYKTGKEITFTETDQTFTVANKKLLQAVELTKLDQADASKNLEGAEFELYKKSNAGFFKVSSHTTDENGQIIINELPPGDYQFVETKAPLHYLLDTSPIGFTIEEEQTAAVKVKKANERGKGSLTIKKVDAADEKTRLKGAEFELYDEKGQFIDRTATDAEGLAVFKDLPFDSYLIKETKAPSGYAIDPASVNIPITIDAPTKELTVKNHKIIHAVKLTKAELGNPSKTLKEARFILMYKKDKNSEYALADVKGEYTTDETGVIYKEDLEPGFYQFIETKAPPGYLLDTTPVEFTIEEEQIHTVSLTKLNRRIPAGGGETPDPEGPGNPGGEEPDPEDPGNPGGEEPDPEDPGNPGGEEPDPEDPGNPGEEEPDPEDPGNPGGEKPDPEDPGNPGGEKPDPENPNEERPDSEEPHTPGISKELNQNGHHGDNGLTKPGTTLPKTGEKANIGMLAGAGFIIFGVWILLYRRKTAA

SEQ ID NO: 28776 - protein, 211 aa, Bacillus sp. 2_A_57_CT2
MKKLITMIALLSFVLFGCSNAPEQPSDVSAEAPKKSEAVKNYAPNPQVPDDRQLEKAGQTHLDEKGELTLKKTKNVNGIHSIGPIEMKVTDAKVMHLKPDYSLVDYFHTLTHDEEFDFVKVFVEIKNTSDQKVNFAPAAILETSKGEQITWEKDIYLDGLTEEIGPNETKAGNVGFIIEKSDLTHFEITTSDVFSADGKKIEEAEKIQIEF

SEQ ID NO: 28777 - protein, 431 aa, Bacillus sp. 2_A_57_CT2
MPFIEQVYAREVLDSRGNPTVEVEVLTESGFFGRAIVPSGASTGEHEAVELRDGDKSRYLGKGVQKAVDNVNNLIADAVIGLDVTDQVGIDRTMIALDGTENKGKLGANAILGVSMACAHAAAESVGLPLYRYLGGFNAKQLPTPMMNIINGGSHADNNVDFQEFMIMPVGAPTFKEAIRMGAEVFHSLKKVLSGKGLNTAVGDEGGFAPNLGSNREALEVIIEAITNAGYEAGKDIYLAMDVASSEFFNKETAKYDLAGEGRTGLTSEDMVNFYEELVNEFPIISIEDGLDENDWEGHKLLTDRIGGKVQLVGDDLFVTNTKKLAQGIEQGVGNSILIKVNQIGTLTETFEAIEMAKRAGYTAVVSHRSGETEDATIADIAVATNAGQIKTGSMSRTDRIAKYNQLLRIEDELGDLAVYDGLKSFYNLSK

SEQ ID NO: 28778 - protein, 268 aa, Bacillus sp. 2_A_57_CT2
MSLIVVLGVYTPSSKAAGYDTKFCEQFKGVTKIWWDGIELKPGQIGRLIVLKDTPLFKLQGDKKVVARTLKAGEFYRIYAFKPGMLSVGGGYYVDRNTKVKYETPSKTKLQAVQCIHNPYGSISNPTALGDGWEVKVEDRYNGLRHYEIGMVEAITDGNVAWQLIKEKNYYNDPPPPGKKYVMAKFYFKLINADKEPFNVNYYDFEAVSKKGVTYSNKSVVIPDPELWADLYKGGSFAGWTVFLVDQNDEPKIVWNRKSTDEIWFKMN

SEQ ID NO: 28779 - protein, 331 aa, Bacillus sp. 5B6
MSIKKMSAVFFILLLTAFTAACSSETSGGQESSTAKVKIKDTAWAASDDTEHPAALKVTVTVKNTGKDPLTVKSSDFSLYQDDAKTAKADKEDLMQNGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFITSAGISQEQADPKAISAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKTS

SEQ ID NO: 28780 - protein, 246 aa, Bacillus sp. 5B6
MMTPVRIEYGRGDNMSSGRNQYMILKQKPYKYMSRHMKRRYEQLPCELERPETGTEKRFSSSDENRSALCVPGLRGPEGKRGPAGSRGPQGEAGPPGPPGPEGPPGAVPAVAFQNIADQMMIPLEGTPINVLSAVIAAPTDQFVKTDAVIQVNVELDPLASHFSLVLAVDLQRNGVSIQTQRQERNLFSSGGQIIGIPFTYIDEMKADETAAYQLYLSVLSSNYVTQVTTANRSLIATGFPIQGSD

SEQ ID NO: 28781 - protein, 2307 aa, Bacillus sp. 5B6
MNNPIINGSFETGTLAGWSSANTQINSLFAHSGRYSAQFIGAQPYAYLSQIVPISAKSVTLFVSLATLGNEPSPQVTLQIIYVSAAGEQISSIQENITPGNLPNVLFHTWSEIYKTSSVPSGAASAVIVLSKVSTGTVLIDDVSLAQTGGEPGVTGITGPTGVTGPTGVTGARGATGVTGVTGSTGSTGATGATGSTGAPGVTGPTGATGSTGSTGVTGVTGITGATGATGATGATGSTGAIGSTGATGPTGATGPTGGTGSTGITGATGVTGTTGVTGVTGVTGATGPTGATGVTGITGVTGSTGSAGATGPTGVTGSTGVTGTIGLTGVTGPTGLTGSTGETGSTGVTGATGITGATGVTGPIGPTGATGITGPTGDTGATGVTGTTGVTGSTGVTGPTGITGVTGPTGLTGSTGATGLTGATGSTGVTGPTGITGVTGPTGESGSTGSTGETGSTGATGATGETGPTGVTGSTGETGSTGVTGATGPTGVTGVTGVTGPTGATGLTGATGSTGSTGVTGVTGRTGTTGSTGLTGVTGATGITGATGTTGPTGVTGSTGATGVTGSTGETGPTGAAGPTGITGETGPTGDTGSTGVTGPTGVTGATGSTGSTGVTGATGITGVTGPTGASGVTGPTGESGSTGITGATGPTGPTGLTGVTGEIGPTGVTGATGSTGVTGATGSTGATGSTGATGSTGVTGVTGSTGVTGSTGVTGPIGITGVTGPTGVTGSTGVTGSTGPTGATGSTGVTGPTGEIVPTGVTGSTGETGSTGVTGATGITGATGVTGPIGPTGVTGVTGSTGETGSTGATGVTGSTGPTGENGPTGETGETGATGVTGATGATGPTGVTGSTGVTGSTGSTGVTGPTGAAGPTGITGETGPTGDTGSTGVTGPTGVTGATGSTGVTGATGSTGVTGVTGSTGATGSTGATGSTGETGSTGASGATGATGITGATGTTGPTGVTGSTGATGVTGATGETGPTGVTGATGSTGETGSTGVTGAIGPAGPTGATGPTGATGATGAIGPTGETGSTGPTGVTGSTGVTGSTGSTGVTGPTGAAGPTGITGETGPTGDTGSTGVTGPTGVTGATGSTGVTGATGSTGETGSTGETGATGASGATGITGEIGPTGVTGSTGETGPTGVTGATGSTGETGSTGVTGAIGPAGPTGATGPTGATGATGAIGPTGAAGPTGITGETGPTGDTGSTGVTGPTGATGTTGPTGVTGSTGATGVTGSTGETGPTGETGPTGVTGSTGATGSTGVTGSTGITGSTGDTGATGVTGATGVTGSSGATGVTGATGETGSTGDTGATGETGPAGVTGTTGATGVTGETGPTGTTGATGTTGATGATGITGATGTTGETGSTGSTGETGPTGVTGSTGETGSTGVTGAIGPAGPTGSTGATGAIGPTGEIGATGVTGATGITGAAGPTGATGLTGVTGPTGVTGAAGSTGPTGEIGPTGATGPTGITGTTGATGVTGTTGVTGPTGSTGVIGSTGPTGVAGSTGETGATGLTGATGVTGSTGVTGSTGATGVTGSTGITGATGATGPIGPTGATGITGPTGDTGATGVTGTTGVTGSTGVTGAIGETGATGLTGPTGFTGVTGPTGETGATGSTGEIGSTGSTGATGVTGITGPTGETGATGSTGATGGTGPTGVTGATGPTGITGPTGVTGATGATGVTGSTGTTGETGPTGPTGVTGETGATGITGATGATGITGSTGATGATGVTGLTGITGATGPTGVTGSTGETGLTGSTGPTGTTGITGPTGITGPTGATGETGATGVTGSTGATGVTGITGVTGPTGATGATGSTGATGVTGSTGATGVTGATGITGATGITGSTGSTGDTGVTGATGSTGPTGATGVTGPTGETGATGVTGATGLTGSTGSTGVTGATGSTGPTGATGVTGPTGSTGPTGLTGETGPAGSTGPTGATGPTGETGTTGSTGSTGVTGAMGVTGSTGVTGATGETGPTGITGATGTTGSTGVTGPTGVTGATGPTGATGTTGLTGVTGPTGVTGATGITGATGSTGATGGTGTTGSTGATGSTGATGSTGSTGVTGPTGVTGSTGSTGPTGPTGLTGITGPTGSTGTTGLTGVTGATGATGVTGATGVTGATGVTGATGVTGATGVTGATGVTGATGVTGATGVTGSTGVTGATGPTGATGSTPALLFTRTNGPLTVYPPLNTEVPVATLAIPVNALQNVKLDYALSVAITSAANSNFVFEVRLYRGTVQIHTRTLSRTNTTAATESFSIADTTVDTAPTAGTNTYQLRIVFTTANNLTAATALNIDFNSISFPTT

SEQ ID NO: 28782 - protein, 665 aa, Bacillus sp. 5B6
MTGITGTTGATGDPGATGVTGATGVTGATGVTGSTGVTGATGVTGATGLTGATGVTGATGVTGATGITGATGLTGETGVTGLTGVTGATGVTGTTGITGDTGATGITGATGVTGVTGETGITGATGATGVTGDTGVTGATGVTGVTGSTGATGSNGITGATGVTGATGITGATGVTGVTGATGVTGSTGATGSNGITGATGVTGATGITGATGVTGVTGATGVTGATGITGTTGVTGATGSTGATGLTGATGVTGATGVTGSTGVTGATGVTGVTGATGATGLTGATGITGATGLTGSTGVTGSTGVTGATGITGATGLTGATGVTGTTGVTGTTGVTGATGLTGSTGVTGGTGVTGATGITGATGATGATGLTGAIGVTGATGITGATGVTGVTGSTGLTGATGVTGATGITGATGITGATGVTGATGVTGATGITGATGVTGSTGVTGVTGDTGATGITGATGVTGSTGATGATGVTGATGITGATGVTGAGAIIPYASGLPTAVTTIAGGLIGTVSLVGFGNSVTGVNVGGGGAIDLTGAGGTLLNFAFSAPRSGTITSIAAYFSTTAALSLVGSTVTITAQLYSSTVPNNTFTPIPGASVTLAPPLTGILSIGSISNGITTGLNIAVTPQTRLLMVFSATATGLSLINTVAGYASAGVTIS

SEQ ID NO: 28783 - protein, 280 aa, Bacillus sp. 5B6
MAMKISLKKKAGFWKKTAVSSLIFTMFFTLMMSGTVFAAGLNTDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMKRSENAGLKTALAKAVMYDTVIQHGDGDDPDSFYALIKRTNKKMGGSPKDGTDEKKWLNKFLDVRYDDLMNPSDEDTQDEWRESVARVDVFRDIVKEKNYNLNGPIHVRSSEYGNFTIQ

SEQ ID NO: 28784 - protein, 430 aa, Bacillus sp. 5B6; identical to SEQ ID NO: 5169

SEQ ID NO: 28785 - protein, 212 aa, Bacillus sp. 5B6
MAGNLVSCKACGKEIAKGVKKCPNCGKDQRNFFMRHKIITLLLAVVVIIILVNIGGGGGSSSSKTASSKAAESKEKLYNIGDTVKTEKTEVTVTKVEKRDSVGSQFVEKKASDGGVIVAVQYTVKNVSSKPLSSFSIPRAKLVDSKGTSYDSDIDASSSYATETKVDNSKILSDLNPNIKVTDVKAFEVDKNAYSKGTWKLKFSNDVEVKIK

SEQ ID NO: 28786 - protein, 971 aa, Bacillus sp. 7_6_55CFAA_CT2
MKSYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKTGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAVINGPYSGNVNEAILFTSNGSKDEDGKIISYKWEFGDGAVSNEQNPTHVYTKEGAYTAKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 28787 - protein, 504 aa, Bacillus sp. 7_6_55CFAA_CT2
MKGSVKLLKVDNEDISKKLEGAAFELKDASGKVVGEYKTDKNGEINVKDLAYGKYSFVEKASPNGYVLVKEPIAFEIKEHGKIIELLAVNHLIKGDLEITKVDVADGNNKLPNAEFTIYNEAGKEVVKGKTDDKGIAKFEKLPFGKYTYKETVAPNGYILNEETFSFEIKENGQIIKHIVKDEKIPSIKTTASDKKDGTKEMHTSKSVTIQDKVEFKDLQVGKEYTLKGKLMDKKTNKPFVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIVGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQPNQDKNTPTTEQPKEQPQSKKEVQSKIGWLPQTGTNLTSWISMAAGALLLIAGGVIFLKRKNA

SEQ ID NO: 28788 - protein, 458 aa, Bacillus sp. 7_6_55CFAA_CT2
MKLKLTSKLERLRTSKKGIGACVLAAGMTAITMTPQSAYAHGFVEKPSSRAALCSQNYGALNLNCGNVMYEPQSLEAPKGFPDGGPIDGKIASAGGLFGGTLDQQTTNRWFKNTIKGGENTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVINTVPGTTFIDKKLKADTEYTYTIKALDSAGNISKESEKLKVKTTHAIPDIEAPAQPKGLHSMGTTATTVDLMWSPSEDNVGVDHYIVYRESAGVMNKIGTATNTSFMDKDLKANTSYKYVVTAVDLAGNESSRSDVLNVTTKLEDSAYEKWDARKAYTKGDRVIHEGKVYEAVQNHQGNGDSNWIFALSLWKPVLNK

SEQ ID NO: 28789 - protein, 370 aa, Bacillus sp. 7_6_55CFAA_CT2
MKTKQTIAASTLALAMIAGANPAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVDEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNSTKNNNAKELPNAGSEQSNNMALGMLSVLGGILLITRNKIKTLFSK

SEQ ID NO: 28790 - protein, 960 aa, Bacillus sp. 7_6_55CFAA_CT2
MNKNLKFTQMMIGISTIALSFGSIQTQVSAEEKAPYNLLQMKPIGTETSKDEMAHATKADETLNFEERLKVGDFSQRPTSVMKHDERQLKQSYTLAELNKMSDSEFIDTLSRVSWNQITDLFQFNQDTKAFYQNKERMNVIIDELGQRGTSFTKEDSKGIETFVEVLRSAFYVGYFNNEVGYLKERSFHDKCLPSLKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEVSRIALIRNLTTENSWLINNGIYYAGRLGKFHSNSNKGLEVITQAMNIYPRLSGPYFIAVEQIKTNYGGKDYDGNAVDLQKIREEGKLQYLPKTYTFDDGSIVFKTGDKVTEEKIKRLYWAAKEVKAQYHRVIGNDKALEQGNADDVLTVVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQKGWSGYKTVTAYFVNYRVNAANQFEYDIVFHGVATEEKEKTTTIVNMNGPYSGIVNEGIQFHSDGTESENGKVISYLWNFGDGTTSTEANPTHVYGEKGAYTVELTVKDSRGKESKEQTKVTVKQDPQTGGSLEEEKVLPFNKLVKGNLIAPDQTDVYTFDVTVPKEVDISVVNEQNIGMTWVLYHESDMQNYVACGEDEGNAIKGKFVAKPGKYYLNVYKFDDNTGEYSLLIK

SEQ ID NO: 28791 - protein, 179 aa, Bacillus sp. 7_6_55CFAA_CT2
MLKKIATVTLAGTLAFSLSACDEKKEVAKTVSNNTKEEQSSAKKENTKNEDTREYNVEKTTQIRNQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLELIYRPDVMSKEEVKVELK

SEQ ID NO: 28792 - protein, 503 aa, Bacillus sp. 7_6_55CFAA_CT2; identical to SEQ ID NO: 26634

SEQ ID NO: 28793 - protein, 504 aa, Bacillus sp. 7_6_55CFAA_CT2
MVKAFDIAGHEFTHAVTSSESNLEFSGESGAINEALSDIMGTAIEKYINNGEFNWTIGEQTGSIFRNMKNPTAINFSEGLPYPDDYSKYNDLNGEDYGGVHFNSSIINKVAYLIAQGGTHNGVNVNGIGEDKMFDIFYYANTDELNMTSDFSELKLACLKVAANKYGTNSIEVQAVQNAFDAAKITGTVKENEKTAENQAPELTVPFTITLRVGDTFDPMRNVKAVDKEDGDLTNKVKHKGDVDTSKPGTYIVEYLVVDSQGGNATATQTVIVEGNGETSDLEPKLTVPVGATIHVGDSFVPMAEVLAIDKEDGDLTSKIKVDGEVDTNKAGTYVLKYTVTDSKGHEVTAKQTVTVKVREEVKNDKPILKVPATTSITEGDQFDPLIGVSATDKEDGDLTSKVAYEGTIDTNKAGIYEIIYSVRDSVGNEVNTIQKVLVKDKETSKPNGLANKTNNSNTDKKEYTYKELPKTGVSTTNSAAIGILMIITGTVLTFVRKFRKIQK

SEQ ID NO: 28794 - protein, 553 aa, Bacillus sp. 7_6_55CFAA_CT2
MKKIFSVLLVLFLTFSTWSSVLVKADSSSKGTLTIHKYEQEKDGAQGLEGDGSANQEVPKDVKPLKGVTFEVKRVASFEKISNDGKIVKEDVKPVMGATPNQVVTDDNGQVVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEIAIEGQKVTATVKDFTKLDGKKEFHLQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKFANN

SEQ ID NO: 28795 - protein, 455 aa, Bacillus sp. 7_6_55CFAA_CT2
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTENRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQMQKVTANSVELTWNASTDNVGVKGYQIFRNGEMIDTVPGTHFIDKKLQPSTEYSYTVKAIDAAGNVSKESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASHEAWDAKKAYKKGDRVLHEGKVYEAVQSYQGNGDPNWIYALSLWKTV

SEQ ID NO: 28796 - protein, 878 aa, Bacillus sp. 7_6_55CFAA_CT2
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEAMNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNIGLNWVLYSESDLNNYVAYATKRDGNKLLGNYNAKPGKYYLSVYKYGGGTGNYTVQVK

SEQ ID NO: 28797 - protein, 336 aa, Bacillus sp. 7_6_55CFAA_CT2
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLHYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKK

SEQ ID NO: 28798 - protein, 431 aa, Bacillus sp. 7_6_55CFAA_CT2; identical to SEQ ID NO: 26534

SEQ ID NO: 28799 - protein, 177 aa, Bacillus sp. 7_6_55CFAA_CT2
MKPEDPKEPKEPELKPEDPKEPKEPEVKPEEPKEPKEPEVKPEEPKEPKEPEVKPEEPKEPKEPEVKPEEPKEPKEPKEPKEPKEPKEPKEPKEPKEPKEPKEPKEPEVKPEEPKDLKKPEVKPEVRLEKLIKEPQAKVEKELPKTGAAHSWMMSVGAGISFLVGGVLFVLGRRRKQ

SEQ ID NO: 28800 - protein, 659 aa, Bacillus sp. 7_6_55CFAA_CT2
MFNQRTKNGVKKILAITAASTVFSMFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSMYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYNKEIYGNTQQNAESKTVPVKVGNFIELTHLEGGERATLTNLDNNKRESFDKKVIYEVTKDGLKKVNQIVNPKPDTEAPTQPQGLYASNVASDSVELKWNPSTDNVGVKEYQVLRDGQLIQTVQGTTFTDQNLTANKEYKYAVRAVDATGNTSIQSDILPIKTKDQNVSYEKWDPKKAYTKSDKVEYQGKFYEAVQSYQGNGDPTWIFALSLWQPFKMI

SEQ ID NO: 28801 - protein, 667 aa, Bacillus sp. 7_6_55CFAA_CT2
MIIKKHPFRTLAKTAVALTMIIPTSQAISQPFAYAQENITKSQQQVAPFWNKNKDYPGESYVTYEGKVYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNIPGLGADLAAAITDVNKLKDAYKSVINTLHLTHMDFDIEGVLVAHPESIERRSKAIALLQKELKAEGKDVKIGYTLPVMPYGLTNDGINVIQSAIKHDVDLNSINIMTMDYGQQNQQMGQAAIDAINSLHGQLTNLYKGTIKDSDIWKMIAVTPMIGKNDTQNETFTLNNAKELFQFAKEKGIGEISMWSVYRDKKATESWQIGQATGDASGLPDVEDGAFSKLFSAFNSNTEIDIIAPTAPSNLRSVNQTATTVELQWEASTDNIGVKEYEVYRDGKKVGTTKTTRYEDAGLQANTKYNYKIKATDAAGNKSKSSNEVSVTTKEENPEQTAPTAPTELQASETTTNSVHLIWEESISNVGIKEYEIYRNGTKIATSPSTYYTDENLLASTEYSYMVKAIDTQGKVSVASNEIKITTKDTSSSEYKAWDSYAAYKKGDRVEHQGKIYEAVQSYQGYGDPNWIFSLALWKVIK

SEQ ID NO: 28802 - protein, 738 aa, Bacillus sp. 7_6_55CFAA_CT2
MKQLKPAISVLGSVSMALTLASPALADVTQPNPGSTVEIFKENANAKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANLGYGYSKTTTETESYTNDFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRIYTPKDKSLADKPVLSYNEVFQHVNIDTKKVNHIVNKAKSTNNVSVVSANNGTDALNDLKAGQGDRGYLHKDSVHGAFAKLQQPTLVEGSYDSVTQKIRASILPGLFGVSKEIPTTYSKKWNAPSQTVTLVKRENGFTYESRENIHPIKSEIAAHRKVTFEINDAHNLTPIQKIDTEIKANKEFEDYVVDNSGEFVTEGVPYTVASYGNTAYWGSHHAGNKWEYLWSEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 28803 - protein, 163 aa, Bacillus sp. 7_6_55CFAA_CT2; identical to SEQ ID NO: 26627

SEQ ID NO: 28804 - protein, 119 aa, Bacillus sp. 7_6_55CFAA_CT2
GRGSGGNESGGSDSGGNGSGGNGSGGSGSHGGNGSQGGNRVKGDSSSQGGNGSQGGNRVKGDSNSEEGNGSQGDNVKDNTKKQGDKLPNTATHYPISILMGLSTFLIGMLLFIRRKNVK

SEQ ID NO: 28805 - protein, 200 aa, Bacillus sp. 7_6_55CFAA_CT2
EGTKEEVKEPVKEVEGTKEEVKEPVKEVEGTKEEVKEPVKEVEGTKEEVKEPVKEVEGTKEEVKEPVKEVEGTKEEVKEPVKEVEGTKEEVKEPVKEVEGTKEEEKEPTKEVEEAKEPKKEVKESATGLDQEPKGNNQVVENEGRKADTLNKQHTNKPEEGKKFLPSTGGEASTSTLLSGITLVLSALSMFVFRKRLFKK

SEQ ID NO: 28806 - protein, 965 aa, Bacillus sp. 7_6_55CFAA_CT2
MNKKSKINKVMLSISTMALSLGALQTHAAAEEKAPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQAFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTVARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHATKSLAAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPAHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKMNAKPGKYYLYVYKYDNGDGTYKLSIK

SEQ ID NO: 28807 - protein, 333 aa, Bacillus sp. 7_6_55CFAA_CT2; identical to SEQ ID NO: 27053

SEQ ID NO: 28808 - protein, 172 aa, Bacillus sp. 7_6_55CFAA_CT2
MGKIFKFGCLGIIAVFVIGIIAMVAGGGDSTEKTSTDTKAVSKEGVSSDVKISVGSMETVDSVGNEYSKEQAQGVFKILEVTLTNNQKDAITVDTNSFKLVDNKGREFTSSVQGQSSFDLANGGKTDFFLKQLNPGLTQTGKIVFDIPKDAEGLFLKASGGMTGKEINLKVE

SEQ ID NO: 28809 - protein, 278 aa, Bacillus sp. 916; identical to SEQ ID NO: 26028

SEQ ID NO: 28810 - protein, 331 aa, Bacillus sp. 916; identical to SEQ ID NO: 26013

SEQ ID NO: 28811 - protein, 430 aa, Bacillus sp. 916; identical to SEQ ID NO: 5169

SEQ ID NO: 28812 - protein, 170 aa, Bacillus sp. 916
MAIQNLINNGSFESGDLTGWSGVSASVVSAFAHTGAFSAQFAGGITSASLSQTVPVSPQQSFQLFISLGKIGTIANPEINLRVLYLDASNAVVGTGLNINVTIGNMPNTIFDTWTEVYQTTTTAPAAAVQAQILISKTAGSSNTPVVLIDDVAFVEVTGITGTTGPTGAT

SEQ ID NO: 28813 - protein, 161 aa, Bacillus sp. 916
VTGDTGPTGPTGITGPTGATGATGSQPTVAFQNAVDQVVIPLDGTPTSVLTATITAVATQLVKIDTTIQLNITLNPLTPDFSLVLSLDLERNGIIISTETLELNLFYSAGQSIIIPHTFVDQVPASGITVYNMVLTVGNTNNVTQVDITNRALNATSFPLP

SEQ ID NO: 28814 - protein, 313 aa, Bacillus sp. 916
TGPAGATGATGAAGPAGATGATGVTGATGATGDIGPAGVTGATGATGVTGAAGVTGVTGATGDIGPTGPAGATGATGAAGPAGATGATGVTGATGATGDIGPAGVTGATGATGVTGAAGVTGVTGATGDIGPTGATGATGATGATGATGVTGAAGVTGVTGATGDIGPTGATGATGSGLSEYAYVYNLSAETVAIEAPVIFDSTGITTAGITHAPGTAQIIVTTPGDYEVTFSVSGVEPNQFTLFVNGGPVTNTVYGSGAGTQQNNGQAIITLAAGDILTLVNHTSAAAVTLQTLAGGTQTNVNASIVLKKLN

SEQ ID NO: 28815 - protein, 138 aa, Bacillus sp. 916
MAGNLVSCKSCGKEIAKGVKKCPNCGKDQRNFFMRHKIITLLLAVVVIIILVNIGGGGGSSSSKTASSKAAESKEKLYNIGDTVKTEKTEVTVTKVEKRDSVGSQFVEKKASDGGVIVAVQYTVKNVSNKPLSSFSIP

SEQ ID NO: 28816 - protein, 368 aa, Bacillus sp. 916
MAIGNLIVNGGFESGDLTGWDVANATVNSIFAHSGTYSAQFLIETNTASLSQIVPVTVGQAYHFQVSLGTIGTASNPQVNLQILYLNSLGVPIATGLDAAITIGHLPNVIFNTWTEVYQTTAVVPDGVTDAQIMISKASVNTNTTILIDDVSLLQVIENSGPTGSTGSTGPTGRTGATGATGITGPTGRTGATGVTGSTGATGVTGSTGATGVTGTTGPTGATGITGPTGPTASAPTLLFTRTNGPLTVYPPLNTEVPVAELEIPVNTLQNVKFDYSVSVDVTSTANSNFVFEIRLYRGAVQIHTRLLSRSIISATTQRFAVADTTVDTAPTAGTNTYQLRVIFTTANNVTAATALNIDFNSIRFPTT

SEQ ID NO: 28817 - protein, 430 aa, Bacillus sp. B14905
MPFITQVYAREVLDSRGNPTVEVEVFTESGAFGRSIVPSGASTGEYEAVELRDGDNSRYLGKGVLKAVENVNTIIAQELEGNYSVLDQVVIDKTLIELDGTENKGKLGANAILGVSMAVAHAAADYLDVPLYQYLGGFNSKQLPVPMMNILNGGAHADNNVDIQEFMVMPVGAESFRHALRIGAEIFHHLKAVLKAKGYNTAVGDEGGFAPNLGSNEEAITVILEAIEKAGYKPGEEVKLAMDVASSELFNKEDGKYHLDGEGVVKTSEEMVDWYEELTNKYPIISIEDGLDENDWAGHKLLTERIGSRVQLVGDDLFVTNTKKLSAGIEQGVGNSILIKVNQIGTLTETFEAIEMAKRAGYTAVISHRSGESEDATIADIAVATNAGQIKTGAPSRTDRVAKYNQLLRIEDQLGSTAEYLGLKSFYNLK

SEQ ID NO: 28818 - protein, 1072 aa, Bacillus sp. B14905
MKKKFTFNQLLIGVSTMAISLGGLQAEASAAEKTPYNVLQMKPIGIEMSKDEMVHSTMAEETLSYEERLEMGDFSQRPAPIMEQMDTQQLQEQYSMAELNNMSNRELIHTLGSIRWYQITDLFQFNDDTKAFYQNEERMQVIINELGNRGSSFTKDDSKGIETFVEVLRSAFYVAFYNNELGYLNERSFQDKCLPALNEIAKNPNFKLGTDEQDKVVSAYGKLIGNASSDVETVQHATNILKQYNENLSTYESENSKGQAIYDIIHGIDYDLQSYLYDTRKEANTTMWYGKIDSFIEEVNNIALIHNVTDSNSWLINNGIYYAGRLGQFHSNPNKGLEVVTQAMHMYPYLSEAYFVAVEQIMTNYGGRDLNGNTVDLQKVREEGKKQYLPKTYTFDDGSIVFKTGDQVTEDKIQRLYWAAKEVKAQYHRVIGNDQALEPGNADDILTVVIYNSPDQYRLNRQLYGYETNNGGIYIEETGTFFTYERTPEQSIYSLEELFRHEYTHFLQGRFEVPGLFGTGDMYQNERLTWFQEGNAEFFAGSTRTNDVVPRKSIISGLSHDPSQRYTAEQTMFATYGSWDFYNYSFALQSYMYTHQFDMFDRIQDLIRANDVKNYDAYRDTLSKDSQLNMEYQAYMQQLIDNQETYEVPQVAEDYLMPHEPKALNEVQQEIVDIAHVKDANMTKHQSQFFNTFTLEGTYVGSATQGESQDWKTMSKQVNQMLEQLSQKEWSGYKTMTAYFVNYRVNAANQFEYDVVFHGVSTDDGETQAPIVQVNGPYTGMIDEKIQFNSDGSKDTDGEIVSYLWDFGDGATSEAANPTHVYENEGTYKVTLTVKNNKGQESKGQTTATVQKGGQTGQEHAMTIPFNKPIKGSLIENDTNVYQFDITSLEEIDISVVNENQIGMTWVLYHESDKENYVAYGQEDGQTIKGKYNAKPGKYYLYVYKFDDENGTYTVQVQNSTKTEIEPNNRPEEATMLPFNTPLSGSLMEDDHTDVYEFNVTSPKEIDISVLNENQIGMTWVLYHESDSQNYASFGQEDGNMINGKWNAKPGKYYLYVYKFENENGTYTVHVQ

SEQ ID NO: 28819 - protein, 345 aa, Bacillus sp. B14905
MGKEQKFLKIKFKSNPGCHCHCCGFCCPCRCKHPFLPVPPTCNYLVYVTDAGQLATPDNRVSVIDTATNTIVATIPVGTAPLEIAITPNGAFGYVPALFSNNVTVFDTATNTVVATIPVGSEPLGVAISPNGALAYVSNHGLGANSVSVIDTATNTVTATIPVGLQPQGIAFTPNSAFAYVANENSGSVSVINTATNMVVATIPVGIRPRSIVFTLNGQFAYVTNENSDNVSIINVATNIVVGTIPVGTGPVGLAITPDGTLLYIVNKGSDTVSVISTATNMVIATIPVGSSPDQVTILPNGTFAYVTNQTDNTVSVIDIATNMVVDVIPGFNGPTGIDTGVICL

SEQ ID NO: 28820 - protein, 452 aa, Bacillus sp. B14905
MMNTKFTKLSKKGLSAALLAAGIIGISTAPNAYAHGFVEKPASRAALCTQNYGALNLMCGSIMYEPQSLEAPKGFPQSGPMDGKIASAGGLFGGILDQQTTDRWFKNTVTGGPNTFTWKYTAPHLTSKWHYYITKRDWNPNKPLTRADLEPIGTVAHNGSAASTNLTHTINVPTDRSGYHVILAVWDVADTSNAFYNVIDVNLVNNGGNVDTEAPTQPNGLHTAKVTSTSAELKWNPSTDNVGVKEYQVLRDGKVVATIPGTTFTDKNLNSNTKYTYSVKAVDAAGNVSTVSESLVVETLHAAPDTESPTQPTSLHTMGITSSSVDLMWGASEDNVAVDHYVIYRGSTKEQMTAVGTSTITSFMDMNLQSNTSYIYAVTAVDVAGNESIKSSILTVTTKEQSTSYEQWSPFKAYKKGDKVEYQGKNYEAVQSYQGYGDPNWINALSLWKEIK

SEQ ID NO: 28821 - protein, 116 aa, Bacillus sp. B14905
MNDFLVTVTDGVTTFEVNISDVTGVGFLPPGPTINLLPPVNSGCECNCRERPIRQLLDTLIGSTVNLLAVNGSIAADFIVEQTGLGIVLGTLPISPETIVRFAISTCKITAVGQTN

SEQ ID NO: 28822 - protein, 61 aa, Bacillus sp. B153
GEDVCEDAITVRGDSEGQESRIIGGGAYHAGDKVVQHNGCGTVNIINFYAEDYGKLFRSCG

SEQ ID NO: 28823 - protein, 164 aa, Bacillus sp. BT1B_CT2
MMFASSGSSTQESKSSGSSAKTTAAKTSEEKSNDDAKEEKTEFGLNETADLDGTHITVTNVKKSMGNEYFKPNNGNEYVVATLNIENKSDKDISYNPLDFQIQNEDGQITHNTFGPSDDNDLSSGNLTPNGKVSGTITFETKRAKHIKLSTLLNFGMTKDYFQP

SEQ ID NO: 28824 - protein, 430 aa, Bacillus sp. BT1B_CT2
MPYIVDVYAREVLDSRGNPTVEVEVYTESGAFGRALVPSGASTGEYEAVELRDGDKDRYLGKGVLTAVNNVNEIIAPELIGFDVTEQVSIDKLLIELDGTENKGKLGANAILGVSMAVARAAADFLQIPLYQYLGGFNSKTLPVPMMNIVNGGEHADNNVDIQEFMIMPVGAENFREALRMGAQIFHNLKSVLKEKGLNTAVGDEGGFAPNLGSNEEALQTIVEAIEKAGFKPGEEVKLAMDAASSEFYNKEDGKYHLAGEGVVKTSAEMVDWYEELTSKYPIISIEDGLDENDWEGHKLLTERLGSKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIQSFYNLNK

SEQ ID NO: 28825 - protein, 222 aa, Bacillus sp. BT1B_CT2
MMKRLAGTVILSGLLVCGFGQALPEKALAAEVVHKTIVVEKGQTYDGKGKRLIAGPELGDGSQREDQKPIFKVEDGATLKNVVLGAPAADGVHTYGNASINNVVWEDVGEDALTVKSEGSVTINGGSARLAADKIFQINKASTFTVKNFTADQGGKFIRQLGGSTFKAVVNIDNCTITNMKEAIFRTDSSTSSVTMTNTRYSKVGQKWIGVKHATERNNHEF

SEQ ID NO: 28826 - protein, 1975 aa, Bacillus sp. BT1B_CT2
MRSKKYSFSLSKKRGLKSFLVTCLALYLIFSQVVGFTLTAVAAGTSTGGSVFFDSVTIKNSEDQTVDGSKGDEPALKPGDKVTLTYEWSLKNDEEAGAENSFTVEVPKSFEFAQDAEGEVKSADQQIIGSYQVKADSNIFTVTLKSPAEGSAGAKGAIALSAKFAADMKSDTKTVTALFQLGAGKTQQVIIPVNTGSESETAKNDPPSSEDDQSDDQSKSSGGQDQEETKKKAADAENSDSKPAASSRLAAAGSLASGGNQITQNILTGVTLTDEHGKPYDKSNRADTNSPAKISITWDIPNELGKTINDGDRYEFDLPEAFIMYNDITNQPLSSDGITYGYFSIDTKGHVVMTFNGEVKEDSNVKGTLFVNTQFNAQKIKGSTTQKIPFPVKSDTPEVTVYFKPKVSKTIDKSGTFDKGINPGQVTWTVDLNKKLDQVKNAKLQNFPEGLTYRSVKVYQLDVNIDGSVSRGDEVLSGYTVDADGNVTFDGEIDSAYRLIYVTDIDDSAKPNEGGNAAFRNKATFGGDNLEPASAEASVTAKYGKMIEKSSTGYKSDSQTFSWTILYNYGEKKIDESKASITDSFGSADLHLVSDSLKVIPITFNQNGSEQAGTPLTEGKDYTLSDNGSGFEIKFNQDVTGAYKITYQTEVNSGVIIDKSTTYTNTAVTGTGESKKASGTAVQQNLIKGYSNIDYKKKTVDWTIAINKNNYTMNNWKLDDNFESGGLTLLDGSFRLQDVTNNKTLEEGKDYTLTIKPDHEGFLLELIGDYATTNSQLKITYTTNMNADFSNENVKNTAESTWTDHSSTERKNKEASSFTPNRQTSHNGFKHGLYNAVSKEITWKIGINYNGEPSKNPYIKDSLADDQQFEKGSVVVKSYSVNKDGSITEGDILPASQYDVEEPSAANKQTLTVHLKTDDSVPYLIEFKTSLKGQVIKHDPYTNKATYHNAGYSERELTASVSVADGGSLVFKGGKQNGGYVDWSINVNASQSVLEDVKVTDTPDTNQILAEDSFKVYQAKYDEKGAVKDSSGNLVPDDVQLKKGEDYTLDIKTDNATGEQSFVLKFTGDYKKIDRAYVIQYQSLINIAGTSGHVNNKVSISGTNVQEQTQENNSSVFVAVSSGGGSGSGERGSLTILKTGEDGTPLSGADFQLRTKDNEQLLRTGTTDDNGKLTFGNIRYGTYILKEIKAPDGYTISDAYADGVSVEINSSSSSAGALYKVVNEKNKVTLIKQDEQKNPLEGAVFKLEKKSGDGAFTTIRTNIKSDKNGKVEINGLPPGDYRLLETKAPEGYLLNTKELGFSVKTNDKNQVPDVDLGALINYKGRAHLTKEDAEGRQLEGAEFKLVDHEGKTIHEKLTSDQDGKTAVSDLAPGRYAFVETKAPEGYVINSKAIEFTISESAKEKPESVDAGKAVNYKGSVYLTKEDAEGRTLKGAEFKIVDHEGKTVHEKLTSDEDGKIAVSGLAPGRYAFVETKAPEGFMLNNDQIEFTIPGSAEGKPEPVDAGAAVNYKGSVHLTKEDAKGHKLEGAVFKIADQNGNTVQEELVSDRNGTVTASGLAPGRYAFVETKAPDGFVLNSGKIEFVIPDSAKGKPEHVDAGTFVNYKGSVYLEKKDEDGNGLEGAVFKIIDSEGKTVKDDLISKEGGKIEAGDLAPGSYQFVEKHAPDGYLLSTDPIPFSITGKHEGEPKQVKLTALNKKNSVVLTKVGQDDKSAGLQGAQFDLTDETGKVLKTGLATDADGRITVYGLKPGNYQFVETKAPKHYQLDKTPISFTVKNTDTKQIELTAENQLTPGDVKLTKVDSNNKKAVLKGAEFKLLDADGKPVKAGGNSKKLPAVWTTDQNGQFTAEGLAPGRYQFVETKAPDGYKLDETPIPFEIKKGQTKPVEVIASNEKLKTPAVDKGAPDPNSGDPKTDNKGTPDRNSKGDPKTNDNGHLKDTLPKTGDTDSIIPIMIGILLILSGGAFAFFTRKKQRKA

SEQ ID NO: 28827 - protein, 595 aa, Bacillus sp. BT1B_CT2; identical to SEQ ID NO: 28584

SEQ ID NO: 28828 - protein, 346 aa, Bacillus sp. BT1B_CT2
MIVAVVSTACGGSKSASGEKEDTKKADNAEVKILSSEYTLPDDSSTNLHENELILKINVSVKNTGKEPLMVDKSQFSLYEGDSKMSDVSVYDERNKRLRSSTLNSDKEVDGNIYYIVEKGKKFQLEYTPDMYGENKADPVKFEIDGGSDELLKTAKKLEDPAKALLAYTDVTIFGKDNNNFDKLVDENKREVVTDYLEGAQKSIVRSLGYYDEEDVDKKKLNKLISAIQNAYQEKSQVKAVTKSISGDEATVEATVTPIDNTDVQKKVKKRLEDYVKDSGKDFMSRDELINPAIDIMSEEIKKAEATSSEKTVEVKLEKSKNDKWKIDADNYKTEQYFSSFLKSNN

SEQ ID NO: 28829 - protein, 278 aa, Bacillus sp. DAU101; identical to SEQ ID NO: 26028

SEQ ID NO: 28830 - protein, 596 aa, Bacillus sp. DAU101
MKKVFSNKKFLVFSFIFAMILSLSFFNGESAKASSDKSYKIIGYYPSWGAYGRDFQVWDMDASKVSHINYAFADICWEGRHGNPDPTGPNPQKWSCQDENGVIDVPNGSIVMGDPWIDVQKSNAGDTWDEPIRGNFKQLLKLKKNHPHLKTFISVGGWSWSNRFSDVAADPAARENFAASAVDFLRKYGFDGVDLDWEYPVSGGLPGNSTRPEDKRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSNCEPADNGEYQKCGPVKEGTWEKGVFDFSDLEKNYINKNGYKRYWNDRAKVPFLYNAENGNFITYDDEESYGYKTDLIQSNGLSGAMFWDFSGDSNQTLLNKLAADLGFAPGGGNPEPPASAPGNLRVTEKTATSISLVWDAPSDGANIAEYVLSYEGGAVSVKDTSATIGQLKPNTTYSFTVSAKDADGKLHTGPTIEATTNSDQTCGYNEWKDTAVYTGGDRVVFNGKVYEAKWWTKGEQPDQAGESGVWKLIGDCK

SEQ ID NO: 28831 - protein, 353 aa, Bacillus sp. HYC-10
MFKKKLSLFLLILCVTVVAAACSGGKDKTAAKESDTKKSLDAAEVKVESAEYTLPPQYDTSVQDDQYVLKVNVSVKNISKEPLNVDKSNFTLYQDDAQVSTISPDDYNEVLSSSSLNADKVLKGGLFYVVDKDKDYQLVYTEPGTGSEKDDKTLEFDIKGKDLMKKAETLQASAKALSSYIDVMIFGKKNDDFEKLTGDNKSTVVNEFDKSFKQGYISSSGISSSSAKDENLDKLLKAVKETLAEKSKVSTKTKSISGDKAVVTVTLTPIDASPLVDRLKEKATEFYSKNRTASYDDAQKYLLSIYPDEFKKLGPSSSEETVEVNMKKNDIDQWKLDLNDYKTSSLVEKFIKN

SEQ ID NO: 28832 - protein, 2020 aa, Bacillus sp. HYC-10
MANAQAEEFQKDIYRSIEFADDEGNILSDHEDQHISKAIVHWSIKGIEIKRGYPYVLSLPSTIQVEKEQKESIIVNQIHVGDYTVSKQNEVTVVLKEDVELDPNLEETLVIEVTNTAAQKEKTKQSKETSAAGDSITTEEEQTSNVQEDVQPQQKQTEEDELLNKVQVSKRLGLQSVTQQTLIKENILTDAQLKYEDQQGNPVDKPDINSLISMNYEWALPNGHSYNGGDEFHFKVPDELVIYEKINRLEMKFNQTTIGYFSVDESGNASIEFTDFIKQYSNIHGTLQIWTKLDQQTVVTEEKEISITPIEGKDTVTIPIHYLPSGPNVSKKGEPNRSYNAETIQWTVDFNMDLDDVKQARLVDPIQNGQSLKKDSIKLYRIDTKLNGETSIGQQIDESHYTIGQTEDGQDFVIEFKDEVHLAYRLVYETDITDQDQSTFRNKASLVSGDKVISAAEGTVNVTRGSPLEKRAAHYDPVTQTITWEIRYNYNEKAIAKKDAILVDFFNGTQELISDSFQVKEVTIDQNGAEAGTKDEEDYTIQDQQKGDQNGFVLQFNHDIQSAYLITYKTKATERIFEAEQIVNTVTAGDESKQANQRIDQQILTKHHGTPNYKNKTIPWSITFNKDQQVMNNLTLKDTFTNEGLTLQKDSLKVMTGNTVLEEGIDYQIVEHENGFDIQLTKEIKTEHTVTYTTSFDYEKRADKDQKNLRNHVKLEWTNEDGKDLTKETDAVFTPDTYTQSNGFKNGSYNAKTKEITWNIGVNYNLKHLDEARVQDFIQGNQRLVKDSITIYSLDLDGGENGTEEKEILPKEDYEIKFLENEKGETGFEVIFKKAIDSPYKITYKTSLEGMALVEKTYGNKATLYEGNTKESDVNAVVSIPNGGKYTSKSGNQQGKVVDWRLNINFGQSTVQDATIIDHPSDNQALIEHSFHLYTTTIDEKGQVTKKDELEKGKDYELNLALNPDSFQIQFKEEITRPYILEYQSLILDKVGSTLQNEVTFKGENVQEIKKESEASIVVKRTAGMGDGTGSAGALTIKKVDASSGKVLKGANFSLTDAVSGIVIGNKTTDEEGNLMFDRLLYGDYTVTEMKAPDGYIKNDEAIQVTIDQPYEAGDQTKMGTVMTVQNQEIKQHVKLTKKDRDTGEALENAEFELKNEAGDTVQTNMKTDEKGEILFKDLEPGSYYFVETKAPKGYQLNTQKWPFTIKENQTETTLVTAMNEILTGSVELSKLGEGNERLAGAQFKLLDNDGHELNGHLVTGEDGKVMVDHLRPGTYQLIETKAPEGYELDDTPIKFEVPLDPKEPVTVSKKNLYQTSAVEVIKEGEDGKTLQGVRFDILDQNGEVVRKGLETDEDGKLFVDNLKPGKYQLVETESVEGYVTKSTPYPFNIEFAQQTPTVINVINDLKTGSVQLTKLGEKNDVLEGAEFKLLDANGKEIETGLITNRDGKITINDLKPGTYQFVETKAPFGHERDETPVTFAIPFNPQKMVNVTKENSRKTGGVALQKKGEDGKSLEGVVFDLFDEHGKMVEGGEGLITNQEGQIKFSGLKPGSYQFVETKSVEGYELSEKPLVFKVELGQTEAVHVEAINQLKKGSVELTKLGEEKERLEGAEFTLLNENGKELMSGLKTDKNGTITVNDLNPGSYQFIETKAPFGHQLDSKPVDFKIEFNPQKKVEVTKENVRMTSAVKLQKKGEDGKRLAGVTFDLFDGHDKRIKKGLKTDRNGQVTVDALKPGTYHFVETASIAGYELDQTPISFTIQLGQDKPAKVEMINKLSPGAVELTKVDEEGHTLEHAEFDLLTHEGKTLKRALVTDQEGKIRINDLKPGDYQLIETKAPHGYQLNGTSIPFTIEKNQKKPLQLTAKNQLILGSLRIIKVDRQTDRTLKGATFDIQSKGGKTIQSVTTGKEGEVIVKGLKPGNYTLTETKAPDGYMTLKKPIKFTIEMGQLNIKTIIVKNEAVKNDQNHSNPPSSHEGDQQPPHNGELPKTGEEWLRYLMYAGILLVAAGTVLLVVRRRAIQ

SEQ ID NO: 28833 - protein, 430 aa, Bacillus sp. HYC-10
MPYIVDVYAREVLDSRGNPTVEVEVYTESGGFGRALVPSGASTGEYEAVELRDGDKDRYLGKGVLTAVNNVNEIIAPELLGFDVTEQVAIDKLLIELDGTENKGKLGANAILGVSIAVARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEDMVSKYPIISIEDGLDENDWEGHKLLTERLGSKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIETFYNLNK

SEQ ID NO: 28834 - protein, 268 aa, Bacillus sp. HYC-10
MYPTHTDRYQKGSWYDAYKDDRWECDSCKKGKSKKLVKNPCCGKDPCVCVIQGSHGGRGRKGPAGPAGPAGPVGPVGPAGPAGPAGPVGQVGPAGPAGPVGQVGPAGPVGPVGPAGPTGVGLTGIVAFDQAAAPTYPIGQVVTYEGSTYVVNSIPPIGTPDTSLNYTLLAAAGATGVTGDPGATGATGATGVGLAGVVPFDAAEAPTYPEGQVVTYEGGTYLVNTAPPAGTPDISPDYTLLAAVGATGATGDTGATGVNGVTGVIVEK

SEQ ID NO: 28835 - protein, 346 aa, Bacillus sp. HYC-10
MNLKKLSALLMISFVMIISAACQSSSKSTNAEQKSTKTAEIKVNSYEYTLPEDTTTTLRDNELVLKVKVTITNKGDKALSLYNSDFSLYQDDAKVSDLKFYGSKDRLDLGSLNKGKSLSGALYFLVDKGKKYQFVYQDSIKKNSDSIEIALDGNKILDTAKKLDNPAKALSAYTDIIVFDKKNDQFSELTGDNQSDIVNKYHEMFVKDFKRSASIYGNEVSDRDILSMYKRMQNTMKDKAKVETSVKTISDDEAKVSAQVTGIDASNLKDKLDKQKDEFYNGKIRSKEELYKKILKMYASEFEKLPPVSSPVEYEVKMKRNGDDQWKIDLNDYQTEQYMNGFIKTR

SEQ ID NO: 28836 - protein, 221 aa, Bacillus sp. I4
MKKIVSILFMFGLVMGFSQFQSSTAFAADKVVHETMIVPKNTTYDGKGQRFVAGKELGDGSQSENQKPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSHVGQKWIGVQHIYENNNIQF

SEQ ID NO: 28837 - protein, 997 aa, Bacillus sp. JAMB750
MKIMKKWATTLLATALVFSSTTAVMAESKIPKDSEGQSFKLVDSNASTLTKSLYAYLQDTSGRQILFGHQHAVDEGLTLTNSGDRVGSTQSEVKNAVGDYPAIFGWDTLSLDGYEKPGNEKNSQAQNRANVVQSMRTVHELGGIIALSMHPENFVTGNQYNDTSGDVVKNILPDGSHHEVFNAWLDNIAAFAHELTDQSTGELIPVIFRPFHEQNGGWFWWGAQTTTASEYKALYRYTVDYLRDVKGVNNFLYAFSPNAPFDGNLTQYLRTYPGDQYVDIFGLDQYDNKANAGQATFLNGLTQDLAMISKLADEKGKIAAFTEYGYSPQGFNETGNYLQWYTAVLEAIKKDPNASRIAYMQTWANFGYPTNMFVPYRDVNGNLGGDHELLPNFVEFYEDDYAAFLTEASGWNLYQDISTIEQEPFMHIVTPTANSQISEAVTIRARVLHDQPSHVVFEVNDSGEEIPMSLDEDGFFYMGKWTPDAAVNHTTVNITVRAYGENQVQEETFPLVVRVSEMLLKEYTFDEGIEGIQNNGTYPDTIETSFEHQVLNGDGKLKINVAGLQASDTWQELKLELTNLHDVQLGNVNRVKVDVFIPKAAVNQSATIRGIVQLPPDWDTKYGMTTTEKNLSDLQSVVIDEEEYVEGQITIDLTSPEASAAATGLALSLVGNAIDFTGAIYVDNIQLIGVSEEEVSDPAIVDDFESYVGNDDLLRNAWVAANGGIAISLDQEEKSAGDYGLAYEYSLAGAGSYTGITKMLGNRDWSSYNSLQFWMNSDGNGQKLVIQAEIGGVHFEAYPSLEANEEGLVTIGFNEFTPAPWESASNLEKLVTEEALKNVTKLSLYINAQDELDSALVSTLFFDEIRAAYVEEEPGEEGEPGEEGKSGEEGKPGEEGEPGEEGEPGEEGKPGEEGELGEEGKPGEEGELGEEEEPGEEGELGEELEVGHKEQGNQSSSGANKLPSTATNVFNFLLIGTLLVIGSTSLLYMRRKKINNE

SEQ ID NO: 28838 - protein, 354 aa, Bacillus sp. JS
MFQKKTYAVFLILLLMMFTAACSGSKTSADKKESETEKSSDIAQVKIKDVSYTLPSKYDKSTSDDQLVLKVNVAVKNTGKDPLNVDSMDFTLYQGDTKMSDTDPEDYSEKLQGSTINADKSVEGNLFFVVDKGKQYELNYTPESYGDKKPKSVTFKIDGKDKKILATADKLQDSAKALSAYIDVLLFGKDNADFEKITGANKNEIVNDFNESAKDGYLSASGLSSTYADSKALDNIVNGIKEGLSKNSSIQAKTTSISKDEAIVEATVKPVDASSLSDRIEDKVKDYYSKNSNASYEEAVKYALQVYPEEFKKLGPASSEKTVEVKMKKNDIDQWQLDMDDYRAAELVEAFIKE

SEQ ID NO: 28839 - protein, 1570 aa, Bacillus sp. JS
MRKGFVPKSYILNLRKTLMIFAILLLVAGNVLTVLPNHIHAEDNTEVTQSADTTCPAPVALINGSFEQGAARGSAYDGSGLYYYESEVPGWKTTDKAIEIWNYAQNIPAVVKNWPAPPDGNRWAELNAFENGMLYQDVKTTPGQTIYWRLSHMGRQGVDTMQVRIGAATSNPYSTVVQKQFSDGRTAWGTHTGSYTVPAGQTTTRFGFEAVSTASGNIGAGNFLDDIFLGTEPCVTANKTVSPQGEVQPGDELTYAVQIKNEGGDVAADASFSDAIPEGTEYVPGSLKLINGSTTKNLTDASDGDGGNFDGNKVNITLGDLPNTNNLPNGMTVQFKVKAKTGYVGKEISNKAQINYDSLLTNTSKKTESNEVTTPVVFKDPVLESKKTSAIKAKAEGNQDADHPEVGDTLLYTIQTRNTVEDSQVKNLAISDTVPEGLDYVPGSLKVDGASVSDDQDNDKGQYTDGKVSGQIGNVTDTEWHNVTFEVKVKPGQAGKDIINTASISGDNIQTPDKPNNEVKVYPRNPALESKKTAAIKEKVEGNKYPDHPEVGDTLLYTIQTRNTEEDSEVKALTISDAIPDGLEYVPGTLKVDGTAVSDDQDDDKGDVTDGKVSGQIGDVTDTEWHNVTFEVKVKAGQAGETIKNTATVSGSNIETPDKPSNDTEIYPRKPDVESKKTASLQEKAEGNKDEKHPEVGDTLLYTIETRNTIEDSLLKDLVISDKLPDGLEYVSGSLKVDGTAVSDAQDDDKGDMTDGKVSGQIGDVTDTEWHTVTFEAKVKAGQAGETIQNTASVTGSNLETPDKPNHEVAIYPRNPDLESKKTSSIQAKAEGNKEENQIQVGDTLLYTIQTRNIVEDSLVKNLVISDELPEGLEYVSGTLKVDNKAVSDAQDDDKGNMTDGKVSGQIGDVTDTEWHTVTFEVKVKAGQTDQKIVNTASVTGDNVDKPDKPSHEVKVSPRNPVLESEKTAKNLDSDKEKYEVGDTVVYTIKTRNTVKDSKVTDLVITDKLPAGLEYVPGTLKVDNKEVSDARDDDKGDVTDGKVSSQFGDVTDTEWHTVTFEAKVKSGQADKNIVNTASISGDNTDKPDTPSQEVKVSPKDPVLKSEKSVKNLDSDKGKYEAGDTVVYTIKTRNTVADSKVTDLVISDKLPAGLKYVEGSLKASNGGEATIKDGKITANFGDVTDTEWRTVTFQAKIESGYAEKTIKNVATVDGGNIDTPDKPGTDIKVDPKDPKLESKKTASIKEIADGNKDEDHPESGDTLLYTIQTRNTVDDSLVKNLVISDSLPEGLEYVAGTLKVDGTAVSDDQDDDHGYYADGKTSGEFGNVTDTKWHSVTFEAKVKSGQAGKDIVNTANISSDNIKTPDKPSHEVKVYPRNPVLESEKTVKNLDADKEKYEAGDTVVYTIKTRNTVSDGKVENLVISDDLPAGLKYVEGSLKASNGGEATFKDGKVTANFGDVTDTEWRTVTFQAKIESGFAGKTITNVATVNGSGIDNPDKPKAEMNVVSKGSEKPNEPAKPSKPTPEKTGEKTNAGKELPDTATNHYNILLFGFGLLLIGSALWYFRRKRNA

SEQ ID NO: 28840 - protein, 236 aa, Bacillus sp. JS
MRRILSILVFAIMLAGCSSNASTEKQHAGGEKTVKAEPQSTSSQKDSTDNYQPNSQVTDDRSLLKVGQTFSDDKGKAVLKDIKQVNKTYKIGDVELTVKEMKLIHLRPDYSMIDYFHELTHDEEFDFVKVFVDIKNTSSKKVNVAPIALMKTNTGETFDWNKDIYLEELNGELEGGAEKSGNLGFIVNASSGHAHDKAADAEKKTKEIKWIEITTSDVFDHNHKKISDAQKIKIKF

SEQ ID NO: 28841 - protein, 1224 aa, Bacillus sp. JS
MQKPERNYMLAVEMVSRQSHCHYVYIKGGNMMRRMMHMVLIMALIFLNVMYTCEAVTAAEPQQAISVEKAKQQKEGQALVEGYAVGQAVSPQHYKLTSPFSNDYNVALADRKNEISPDHILPVQIPSAFRNQFGLQTNPLLLGKKITVQGKLENYFNTTGLKNVQSMNLTDDTKTPPAEHTMTINEARGRLNEEVTIKGIVTADQNAIGGGKLSTFLQDETGGINMYSPSPEQFPELKEGMDVTVTGRITTYQGLKEIVPVLSGIKINQSNQPLPAPKQLTINELINGSLGDQYEGRLVTLTAFVSSIPSSPSGGGYNVTMIDDDHHAMTLRVMNETGVIDELNEGKWYEFTGVLSRYQSFQLLPRKSSDLKLLEEQPAPPSAEGEYEGVVDRVVDGDTIHLKSPVLGTTKIRFVNVDTPETYHTPKNDADENQLRFGKKASDYLKTVLSPGDKITVKVGSEAKDSYGRLLGQVITESGSNVNLELVKNGYAPTYFIWPVDNEEDYQQFQSAVAAAKKEQKGIWNENDPLMEMPFEFRAREQGKGLTRYVGDSSNQTYVQPADWKRVAVENRIFFASAKEAENAGYKMRQTAPEKNVPLRILSMNDLHGKIDQQYELDLDGNGTADGTFGRMDYAAAYLKEKKAEKKNTLMVHAGDMIGGSSPVSSLLQDEPTVELMEDIGFDVGTVGNHEFDEGTDELLRILNGGDHPKGTSGYDGQNFPLVCANCKVKSTGEPFLPAYDIINVEGVPVAFIGVVTQSAAGMVMPEGIKNIEFTDEATAVNEAAKELKKKGVKAIAVLAHMSAEQNGNAITGESADLANKTDSEIDVIFAAHNHKVVNGEVNGKLIVQAYEYGKAIGVVDVEIDKTTKDIVKKSAEIVYVDQSKIEPDASASAILKKYETIAEPIISEVVGEAAVDMEGGYSNDGDTPLGNLIADGMRTAMKTDFALMNGGGIRETLKKGPITWGDLYNIQPFGNVLTKLEIKGKDLREIINAQISPVFGPDYSISGFTYTWDKETGKAVDMKMADGTEIQPDATYTLTVNNFMATATGTKYQPIGLLGKNPVTGPEDLEATVEYVKSFDEPIAYTKEGRIKLAAASDIEDPVTEDPVTEEPGDDLGTEHPMKEVPEPDVDLPDIKETPGTAPVHQLPPSAILRFVEIPINNTKNAANSISTLPLRNEGGESGSEHPLPDTSANYYNFMVIGAAVTLSGTYLYVRRKRSASRT

SEQ ID NO: 28842 - protein, 214 aa, Bacillus sp. JS
MKKVLLLLFVLVIGFSLSACSQSSDASEKEKPKEKKSQEELEKELDKELKKGGEPKIKKDDQIHKIGETIKVNDINFTVNKVDREQNGQYGDLGGKESDKIKTLKGNEERLIIEVTLEYVGKGSMEYSRLGLDLKDKKNKSVRSVISLEDKGKMFLGGNLASGKKVTGVVSYVIPKGEQKNYTLVYNPFLTDTRSDRIEESAKYNIDYLIKLEK

SEQ ID NO: 28843 - protein, 278 aa, Bacillus sp. JS
MNISLKKKADFWKKAAISLLVFTMFFTLMMSETVFAAGLNKDQKRRAEQLTSIFENGTTEIQYGYVEPLGDGRGYTCGRAGFTTATGDALEVVEEYTKAVPNNKLKKYLPELRRLAKEESDDISNLKGFASAWKSLANDKEFRAAQDKVNDRLYYQPAMKRSDNAGLKTALARAVMYDTVIQHGDGDDPDSFYALIKRTNKKAGGSPKDGIDEKKWLNKFLDVRYDDLMNPANHETRDEWRESVARVDVLRSIAKENNYNLNGPIHVRSNEYGHFVIK

SEQ ID NO: 28844 - protein, 430 aa, Bacillus sp. JS; identical to SEQ ID NO: 26029

SEQ ID NO: 28845 - protein, 221 aa, Bacillus sp. JS
MKKIVSILCMLGLVMGFSQFQSSTAFAADKVVHEIIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSHVGQKWIGVQHIYENNNIQF

SEQ ID NO: 28846 - protein, 1970 aa, Bacillus sp. JS
MIISLAIFFFFSQIASYTLTAQAVGVTPSDSQFFDSVTVKDAKGRIVDGSKGSEPALTPGDDVTLTYELSLKKDKKADSEQDINVEIPKSFTFDKGAEGEIKSADQVIGSYQVPAGSSTMTVKLTTASADSPDAKGTITLPAKFTADVKDDEHTAAALFQLGGGKTQQVIIPVKKEETPDDEEEEPKNDSSDTAGDQKGADDKSAPSASKEQKEEEQQPSADSKSGESSKSDDSKKVSSSSQSAFKSLQTEEKQITQNILTGVTLTDENGEPYDKGNRANTNSPVKISIDWAIPDDLGKTINAGDKYEFDLPKEFIMHNDIVNLPLSAGDTTFGTFSIDTNGHVVMTFNSEIKESSHVKGTLVINTQFNEKKITGSTTQKIPFPVNADTPETTVYFKPNVSKTIDKSGVLDKGINPGKVTWTVDVNKKLDQVKNAKLTESLPDGVIYRSVKVYELNVNIDGSVSRGNEVSSGYSVDSKGNVTFDGTIDSAYRLIYETDIDNSAKPSEGGNITLTNKAAFSGDQLEPISAEATVAAKYGKMIAKSSTGYDGESQTFSWALAYNYGEKQIDQSKASIKDSFGTGDLHLVKDSLKVVPITFGQNGGEQAGTPLKEGEDYTLIDNGNGFEIKFNKTITSAYKITYQTKVNSGVIIDKSTTYTNSVVTGTGDSKEASGIAIQQNLIKGYSNVDYEKKTVDWTITVNKNKYLMNNWTLNDQFESGGMVLLDESFKLQDITNNKTLQKDKDYTLTKKPDHKGFTLALIGDYAKTDSQFKITYTTTFNADYSNEIVKNTAQATWTDQNGNERTNKVSSGFTPNHQTSNNGFKNGSYNAVSKEITWKIGVNYNGEPTKNPYIKDAITDPQQFVPGSVVVKSYTINKNGSITEGDALDPSKYDVEEPSANNERTLTVHLKTGDSVPYLIEFKTSLKGQVIDQNQYTNKATYYNDGYADRTLTGSVSVTNGGSLVFKGGKQNGNYIDWNINVNSSQSTLDDVKVTDTPDENQILDADSFKVYQAKYDENGVVKDSSGNLTAGDLELQKDKDYTLDIKTDNTTGEQSFVLTFIGSYKQIDRAYVIKYRSLINIAGTSGHVKNKVSISGTNVKEQTQENSSSIFVAISSGDGSGSGEKGSLTIFKTGEDDKALEGAEFQLWSEDSKQLLRTGTTDAGGKLAFGNIRYGSYVLKEVKAPDGYTISDAYAKGVSVKIDSNSSKTGALYKVVNQQNKVTLIKQDEQNNPLAGAVFKLEKKSNDGTYTLIRTDIKSDKNGKVEMNGLPAGYYRLTETQAPAGFIVNTKAIHFSIAKNEKNQVSDVNLGKMTNYQGKVSLTKESAEGQKLEGAVFNIVDQDGKVVQEKLTSDKDGKIEASGLAPGRYAFVETKAPAGYVLNTKKKEFIISESAAGKPEAADAGIVVNDKGSVELTKEDADGKKLEGAVFKIIDNEGNTVQEGLTSDKNGKVAASGLAPGRYAFVETKAPAGYVLNTEKMEFEISDSFEGKPAATDAGVAINHKGSVELTKENAEGKKLEGAVFNIVDEKGNTVQEELTSDKDGKVKASGLAPGRYAFVETKAPAGYVLNTEKKEFIISESAAGTPKSADAGIVVNYQGSVQLTKEDQDGKGLAGAVFKITDSDGNTVRDDLVSKEGGKIEVDGLAPGSYQFVEKQAPDGYLLSEKPVSFTIKAEYGGKPEQVKVTAVNTKNLVVLTKVDQHDKNKVLQGAEFNLADANGKVLKSGLVTDDKGQITVHGLKAGEYQFVETKAPKDYELNQTPISFKITNTDTKTVEITAENILAPGDVNVKKVDQDNKNTILEGAEFKLLDESGKPVKTDGYGKELSELWKTDQTGQFTVKGLAPGSYQLIETKAPEGYKLDETPIEFTIEKGQSKAVEIVVSNQKVKTPTPDKHDHPDKPTPGGNGKDDGDHSKTNGTAGSSDGQTNTDNTLPKTGDTDSMLTAMIGILLLMAGGGLAVASRKKQRKG

SEQ ID NO: 28847 - protein, 213 aa, Bacillus sp. JS
MAGKLVPCKACGQEIAKGVKKCPNCGKDQRNFFMRHKIITFILAIVVIIIIGNMIGGGGGSEATSKTSSSSKAETEKTYNIGDTVKTEKTEVTVTKVEDRDSVGTQYIEKKASDGGTIVAVQYTVKNVSKKPISSFSIPTVKLVDADGTSYDADIDASSTYATETKVDNSKILSDLNPNIKVTDVKAFEVDKEAYAKGTWKLKFSNDVIVKVK

SEQ ID NO: 28848 - protein, 273 aa, Bacillus sp. KFB-CO4
MREADWWGKAAISLLVFTMFFTLMMSETVFAAGLNKDQKRRAEQLRRICEDGTTEMRYPYVARLDDARPSTCGPAGVTTATRDGFEVVPVYKQAVANKKLPNYLAGLRRLEKEASDDTSKLKGPASAWKSLADDKAFRAAQDGVNDQVYYQPAMERSDNAGLTTALARAVMYHTVRQRGDGDDGDSRYALIKRTPKGAGGSPKEGIDEQKCLNKFSHVRYDDLMNGANHDRRDEWRESVGRVHVLRSIANQNNYNLNGGIHVRSHEYGNGVIK

SEQ ID NO: 28849 - protein, 492 aa, Bacillus sp. KSM-N252
MKSRKKIIPICMALILTLALLMTGNPVSADNSVVGQNGQLSISGSQLVNQNGEPVQLKGMSSHGLQWYPQFVNYDSIKWLRDDWGITVFRAAMYTSSGGYIQDRSVKDKVIESIEVAIDLGIYVIIDWHILSDGDPNIYKEEAKEFFADISARYGHYPNIIYEIANEPNGNVNWNNHIKPYAEEVIPVIRANDPNNIIIVGTGTWSQDVHDAANNPLADPNVMYAFHFYAGTHGQMLRDRVDYALSQGAAIFVSEWGTSAATGDGGVFLNEAQVWLDWMDERNLSWANWSLTHKAESSAALMPGANPRGNWTAAELSPSGAFVREAIRSSSPPSQPPSEPEPPSEPEPPSEPEPPSDPGTYPAWSSSQVYTGGEIVTYDGQLWRAQWWTQGQAPGQQWGPWEPLGSSLPPSEPEPPTEPEPPSEPEPPSEPEPEPPSEPEPPSDPGTYPAWSASQIYTGGEIVSYSGQLWRAKWWTQNQTPGDQYGPWELVN

SEQ ID NO: 28850 - protein, 430 aa, Bacillus sp. M 2-6; identical to SEQ ID NO: 28742

SEQ ID NO: 28851 - protein, 553 aa, Bacillus sp. M 2-6
MYNQFDHKCPFCGRYHEQPHYKRSRHDRPQRRDCPFIKQEHSKQNRPQGDPSCAKGEKQSKIIQRVGRRGPAGPVGPTGPTGPAGGLTGVLPFNPSQSQDYEAGQVVTYNGSTYIAKVDAPSGIPGLSPDYTLLAASGKTGPTGPTGVGLSGIETYDPERASMYSVGQVVTYEGGTYIVNSAPPLGTPDTSPDYTLLAASGAPGSTGVTGSTGATGITGSTGPTGATGITGATGSTGATGITGSTGPTGATGITGSTGPTGATGITGSTGPTGATGITGSTGATGATGITGATGSTGATGITGSTGPTGATGITGSTGATGATGITGATGPTGATGITGSTGPTGATGITGSTGPTGATGSTGATGATGGTGPTGATGITGATGGTGPTGATGITGATGGTGPTGATGITGATGASGPTDTALYAGNTTGPTIITIAGGTNIALPSNQNINGFTPNGSNDTFTVQQTGKYYITYQVNTTTALLVSTRLWLNGSTAIPGSIQSSAVSTTFMSNTVIVNLTAGNTISLQFFGAVVTAILIGGGATGASLTIIRLS

SEQ ID NO: 28852 - protein, 191 aa, Bacillus sp. M 2-6
MKKFFKIGCLSIIILILIIIFVSCMAGGGSKKDNTSNTGSKNAVTSSEKKNDKEKTHKIGDKVAVEDFTYQVNSVTEAKSLQKQYMSDVTTDGKFVIVEVTVKNTGKKGRMVDTEMFRLIGKDGTEYKSLATNNMYVNDTDSSFFLKQINPKLSKKGKIAFEVPNEKKFSLQVSSGLGWTGGKYKTIDLSK

SEQ ID NO: 28853 - protein, 103 aa, Bacillus sp. M 2-6
MNNVTFTAPDTFTIQQSGNYDINAIVSAVAGQAGPLGIDVVIDGITSIAGGRVRGTTAGQEVTAIGFTGAIFAGQTIRLTNTSGQAITTDYVRLTLNKIGETI

SEQ ID NO: 28854 - protein, 353 aa, Bacillus sp. M 2-6
MFKKKLSLFLLILCVTVVAAACSGGKDKTAAKESDTKKSLDAAEVKVESAEYTLPPQYDTSVQDDQYVLKVNVSVKNISKEPLNVDKSNFTLYQDDAQVSTISPDDYNEVLSSSSLNAGKVSKGGLFFVVDKEKDYQLVYTEPGSGSKKDDKTLEFDIKGKDLMKKADTLQASAKALSSYIDVMIFGKKNDDFEKLTGDNKSTVVNEFDKSFKQGYISSSGISSSSAKDENLDKLLKAVKETLAEKSKVSTKTKSISGDKAVVTVTLTPIDASPLVDRLKEKATEFYSKNRTASYDDAQKYLLSIYPDEFKKLGPSSSEETVEVNMKKNDIDQWKLDLNDYKTSSLVEKFIKN

SEQ ID NO: 28855 - protein, 346 aa, Bacillus sp. M 2-6
MNLKKISALLMISFVMIISAACQSSAKSTKADQKSTKTAEVKVNSYEYTLPEDSTTTLRDNELVLKVNLTITNKGDKALSLYNSDFTLYQDDAKVSDLKFYGSKDRLDLGSLNKGKSLSGALYFLVDKGKKYQFVYQDSIKKNSDSIEIELDGEKILDTAKKLDNPAKALSAYTDLIVFDKKNDQFSELTGDNQSDVVNKYHEMFVKDFKRSAGIYGNEVSDRDILSMYKRMQNTMKDKAKVETSVKTISDDEAKVVAQVTGIDASNLKDKLDKQRDEFYNGKIRSKEELYKKSLNMYASEFEKLPPVSSPAEYEVKMKRNGDGQWKIDLNDYNTEQYMSGFIKTR

SEQ ID NO: 28856 - protein, 2045 aa, Bacillus sp. M 2-6
MKRILSLALIAVLVIQSSILGILPLAGAQAKDIQENIYGDIEFADSEGNKLSNIEDQQVRKAIVHWSIKGIDLKKQYPYVHTLPSAIQVEKEQKESITVDDIIVGEYTVSKQNEVKVIFKDDVEINPNLEGSIDINVTSIAEQKEKTKQNEREESLPKDDSTLSEKEDKNQEAAQTKQSDEDELLKNKVNVSKRVGLQSVSKQMQIQENLLTDAKLIFEDQEGNSVDKPDVNSLISINYKWAIPNGHNYNGGDEFHFKVPEELVIYEKIDRLEMKFNQSTIGYFSVDESGNASIEFTDFIKQYSNIQGTLQVWTQLDKKTVITEEKEVVITPIEGKDTISIPIQYIPNGPNVSKKGEPNRSYNAETIQWTVDFNMDLDDVKQAKLLDPIQEGQALKKDSIKLYRVDTKLNGETSIGQLLDENHYTIGQTADGQDFTIEFKDDVHLAYRLMYETDITNQDQSVFRNKASLVSADKEISSAEGTVNVTRGSPLNKKAAHYDPVTQTITWEIRYNYNEKKLAQKDALIEDFFNGTQALISDSIQVKEVTIDQNGNEAGTKAFENYVVQPQTKDEQNGFTLQFNQEIQSAYLITYQTKATDRIFEAEEIINTVTAGKESKQAKQRIDQQILTKNHGTPDYKNKTIPWRIIFNKDQQTMNNVILKDTFTNEGLTLQKDSLKVTTGNTVLEEGTDYQIVEHANGFDIQFMKEIKTEHTITYTTSFDYEKRADKDQKNLRNHVKLEWVNEDGKDLTKENQSVFTPDTYTQSNGFKNGTYDAKKKEITWNIGVNYNLKHLEEAKIEDFIQGNQRLLKDSIIVYSLDLQGGENGAEEKEVLAKEHYDIKFLENEKGESGFEVIFKHAIDSPYKITYQTSVEGMDLVQKTYENKATLYDGKTKESDVNAVVSIPNGGKYTSKSGNQQGKVIDWKLNINFGQSTVQDATIIDHPSSNQAIIENSFHLYSTTIDEKGQVTKKDELEKGKDYELDLEFDPDSFQIKFKEEITRPYILEYQSLILDKVGSTLQNEVTFRGENVKEIKKESEASIVVKRTAGMGDGTGAIGALTIHKVDASSGKALKGATFSLTDAASGIVIGTKTTDEEGALRFDRLLYGDYIVTEEKAPDGYLKTKEPINVTIDQPYESGDQTKIGNSMTVQNQEIRHHVKLTKKDKETGTALENAEFELRNESGDTVQTHLKTDEKGEILFKHLEPGSYYFVETNAPKGYQLNQQKWPFTIKENQTETTVVTAVNDIIKGSAELSKIGEGGERLEGAQFKLLDQDGHELNGALVTGKDGKITINELRPGTYQLIETNAPDGYVLDETPITFEVPLDPKEPVIISQKNLYETSALEVMKEGEDGKKLQGVQFEVLDQNDKVVRKDLTTDEDGKLLVDDLKPGKYQLVETESIDGYQKKNKPYPFTIEIAQKKPAEIKVINDLKTGAVQLTKLGEKNDVLEGAEFKLVDANGKEIKTGLVTDENGEIIVNDLKPGTYQFVETKAPFGHELDETPVTFAIPFNPEKLVSVTKENSRTTGGVLLHKKGEDGKSLEGVVFDLSDAKGKIVAGGEGITTNQDGKITFTGLKPGTYQFVERKSLEGYELSAKPLVFEVELGQKDLIQVEAINQLKKGSVELTKIGEEQERLKGAEFTLFNDDGKELMSGLTTNEKGIITVNDLKPGAYQLVETKAPFGHQLDAEPVDFKIDFNPNQLVKVTKENIRTTSAVKLEKKGEDGQLLAGVTFDLIDAHDQRVKKDLKTDKNGQLTVDQLKPGTYQFVETASIAGYELDQTPVSFTIRLGQDKPAKVEMINKLTPGAVELTKVDAEGHTLENAEFALQSKDGKTLQKSLVTDQKGKLHINDLKPGEYQFVETKAPHGYELDDQPIRFTIEKNQQKPLQLTAKNHLILGSLRIIKVDQQTDRTLKGAAFDIRTKAGKTIKSVTTGKDGEAIVKGLKPGEYTLTETKAPNGYVALKKPLAFTIQMGEVEIKTLIVKNAPMKNEEDHTNPPASDQGDQHPPHGSNGELPKTGEEWLRYLMYAGILLVVSGTVLLVVRRRTIQ

SEQ ID NO: 28857 - protein, 226 aa, Bacillus sp. M 2-6
MTGATGATGVTGDTGPTGATGVTGATGVTGDTGATGATGTGATGATGATGATGATGSSAIIPFASGTPAVLTTIAGGLVGTSSLVGFGNSATGVSIVGGIIDLTGAAGTLLNMAFSVPRAGTITSFAGYFSTTAALSLVGTSITVTASLFASPTPDNSFTQVASVTLAPALTGVLTIGAITNGIATGLNVPVTPQTRLLVVFSATATGLSLVNTVAGYASAGLSIT

SEQ ID NO: 28858 - protein, 431 aa, Bacillus sp. NRRL B-14911
MPFIQHVYAREVLDSRGNPTVEVEVLTESGFFGRAIVPSGASTGEHEAVELRDGDKSRYLGKGVQNAVDNVNNLISEAIIGMDVTDQVGIDRTMIELDGTENKGKLGANAILGVSMACAHAAAESVGLPLYRYLGGFNAKQLPTPMMNIINGGSHADNNVDFQEFMILPVGAPTFKEAIRMGAEVFHALKKVLSGKGLNTAVGDEGGFAPNLGSNREALEVIIEAIKSAGYEPGKDILLGMDVASSEFYNKETGKYDLAGEGRTGLSSEDMVNFYEELVNEFPILSIEDGLDENDWEGHKLLTDRIGGKVQLVGDDLFVTNTKKLAQGIEQGVGNSILIKVNQIGTLTETFEAIEMAKRAGYTAVVSHRSGETEDATIADIAVATNAGQIKTGSMSRTDRIAKYNQLLRIEDELGDLAVYDGLKSFYNLKK

SEQ ID NO: 28859 - protein, 300 aa, Bacillus sp. NRRL B-14911
MTNLHKLAKPKVIFTILTLLLLTFFPTLKAFSEEKEIDINTNLNGYFFHVGDLKPGDWMPRDITIINNGKQDFRYSSIIGKKKSVKGLFEELELLVKKGNDTLYEGKMKDFKGFTPRPLNKGQSETLFFQVTMPYELGNAFQDSSAEVEILFVAEALDGGGDPPGDGDPPGDGDPPGDGDPPDDGDPPGEGNPGEDPGDNPGDEDPPGEDNPDDGDDPGEGDSEDPGDDSSGPGNNPDEPASGNPGSDPGDGITVTPEIRENILPDTATNTYNFMLLGGILLGAGGILLLVRYRRIRKDH

SEQ ID NO: 28860 - protein, 595 aa, Bacillus sp. NRRL B-14911
MVLMARRKSWIGLIVLIFVCSVTLLPGNSKAAGQFITGTYAGKPYKLYVPDQYNESQSYPLYVMLHGCTQDASQFATGTKMNTLADEKGFLVLYPEQTSSANSNKCWNWFEAAHQSRGSGEPAAIAGMVNLIKNNYSVQGDQVYAAGLSAGAAMSVIMGAAYPDLFSGIGVGAGLEYKAATSMTGAFTAMSSGGPDPVRQGRAAYQAMGSQADTMPVIVFHGTSDYTVAPVNGNQVITQWAVTNDLAQNGKEDGWIDDQPDQTENLNVPGGKSYTVSHYKAGDGRVWMKKVTVQSMGHAWSGGNVQGSYTDPQGPDASRMMWEFFHSFAGGDDGGDAGDAPATSASPKGGTYNQPVYVELQTNKEASTYYTVDGSNPTAQSTLYTGPIYIYDDTTLKFFSQDSSGQRESVKEEVYIIEEDAPPGDSLTFSAISGESGFAGRFTADGKGSGDIKAGDKGMYNTDTFRGILSFDTSTLGQTAIGSAKLRLYTKLITGAVTDVKIDMKNGTFGSAPIEQNDYSAAATLTDIASFQPAAVSNYIDIDIPASALAQINRSGKTQFRLKAATAASFNQNSVLFYGGGNGDLSPVLIVNRAN

SEQ ID NO: 28861 - protein, 910 aa, Bacillus sp. NW-2004b
LDRAIKPSEAGALQLVEHNGQMTLADQFGNPVQLRGMSTHGLQWFGEIVNDNAFAALSNDWGSNMIRLALYVGENGYATNPDLIEKVYKGIDLAIEHDMYVIVDWHVHAPGDPRAEIYSGAAEFFEKIAAKYPNNPHIIYELANEPSSNSNGGPGITNDEAGWEAVKEYAQPLVDMLRNSGNADDNIILVGSPNWSQRPDLAADNPIDDHHTMYAVHFYTGTHAASSESYPEGTPSSERSNVMSNARYALENGVAVFATEWGTSQADGNNGPYLDEANVWLNFLNENNISWANWSLTNKNETSGAFTPFEMGKSDATNLDPGDDQVWSMEELSVSGEYVRSRILGIPYEPIDRTASEGFTEIIWDFNDGTTQGFGLNADSPVQEISVTNENNTLQLSGLNASNDLSEGNYWANLRLSANETTARPDIFGAEEITMDVLVSEPTTISIAAIPQSANHGWINPRHAVIVTPDQFELQGGSDLYKAIVSISREASPALEAITTDADDSVMSNIIFFIGTENADVIQLDNIAVSGNRAAVEAPIVHADLGTPTLPSDFENGTRQGWTWHGGSGVKTELTIQEANGSNALTWEYAYPEVKRSDYWASAPRIMLGGIEATRGEFNYLAYDLYIDPIRATEGSIRINFAMAPPAHGFWAQSSEVFEIDLPSLEEATQTADGLYHFEVVFDMNKISPVIASDTILRDMEFIIVDGQSDFAGRMYLDNVRFTNFDEGEVPVVEEPEVEEPVTEEPVVEGPEAEEPVTEEPVVEGPEVEEPVTEEPVVEGPEVVEEPVVEGPEVEEPVTEEPVVEGPEVEEPVTEEPVVEGPEVVEEEEAIAPTPGKEKGKEKVKEDKVKDEKTPAPAKGEKAKDEKKKGEEEGQVLPNTATNVFNFLLIGALLLAAGAVMVFVRKRRAV

SEQ ID NO: 28862 - protein, 222 aa, Bacillus sp. P-2850; identical to SEQ ID NO: 28587

SEQ ID NO: 28863 - protein, 596 aa, Bacillus sp. SC081 [sequence omitted]

SEQ ID NO: 28864 - protein, 585 aa, Bacillus sp. SG-1
MTVALIMVLACLVFPGSYSAAGQFLNGSYGGKPYKLYVPNGYDSNKTYPLYVMLHGCTQDASQFATGTKMNTLADEKSFLVLYPEQTSSGNSNKCWNWFETAHQSRGSGEPAIIAGMVNTVKNNYSIQDEHVYAAGLSAGAAMSVIMGATYPDLFSGIGVGAGLEYKAATSMSGAFTAMSSGGPDPTQQGISAYGAMGSRAKMLPVIVFHGTSDYTVYPVNADQVTTQWAVTNDLAQNGADDDWIDDRAERTENFTVPGGRSYSVSDYEAGDGKVWMKKVMVHSMGHAWSGGSSQGSYTDPNGPDASRMMWEFFDSFKDGSDGETDTTAPVTTADPQGGTYNQSVQVALQANEEATTYYTVDGSAPTVNSTLYTEPILITENTTIKFFSVDSSGNKETTKQEIYVIDESAPPVEGLTIPSLSAEDGFVGQFTADGKGTGDIKVGDKGMYNTDTYRGILSFDTSTLGQTTIESAVIRLYTKSLKGTVSAVGADIKNGTFGTAAIEQSDYSAVASLSNVASVQSPSATGYIDLVLPASALTQINKGGKTQFRLKATTTAGYNQNQIEFYGGGNDAQSPVLIINGGTE

SEQ ID NO: 28865 - protein, 1075 aa, Bacillus sp. SG-1
MFMRSKKQWFSILGTAVLAGSLFSPLNAGATKSPGPIESANFLDHHTAEKLYDVRNVLSKVMPTQQQLKAADQLIAKTGPGVKIQWNSTFGTPSMIVKDGGYLSGTSTKDAETTARDWLKSNSTLFGLTEAEVDTLKVIRNYKMPGTGLQPVTFQQTFDGIESVYGGRVIVAVNKEGKILSVTGNVSPSKNLAESFTLAESDALQRVLELEAPSINLVPKLLRTKNGWQEFDGGDVLPTVQRVKKAAFIRNDEVRPAYRVLFIEELDEGYEVVIDGVTGEKLYQRSLVNHIIDSSGEIFENYPGAPAGGKQVVKSFKGDPAASPLGWVSPTTKTGVTTLGNNANTYANWSNFLAPIDQVVRPVNAFGQFYYPFLNSWQKSQGATTPPSYADDVNSAAANLFYHHNLFHDYFYNLGWVERAGNLQTSNFGKGGAEGDAILGLVQAGALSGGAPTYTGRDNAYMLTLPDGIPAWSGMFLWEPIQGAFHGEYADGDYDAGIIYHEYSHALSNRLVAGGESLGSHQAGSMGEAWGDWYAMHYLIKNGLQEKPVVGAYVTGNTERGIRSWALDDAPLNYGDIGFDIVGPEVHSDGEIWSAILWEVRETLINEIGKEKGEEVIEQLVMDAMPISAPNPSMAEMRTAMITADFERYGGQHSNTLWAAFASRGLGVDAYSDGGNDTDPTPAFNHPDSDQNGLLAGRIINSATKKPIENARVIIGEYEARTSAAVTTGQAGVFGLPMVSGTYDITIQAQGYGSRTFENIQVEAGKIKPLQFKMEPNAASMFNGASVVSVSSESDSNPVKMAIDDTEASVFASAAEENGFTGAEFTVDLAGDKPVKISHIQVSAFKDISKGRFATLKDFEIQTSLDGSSWTTVAEDQFVTQKPRPAAPDLHYKQLELAEPVKASFVKLVAKSAQDESAGYVQVAELQVFSEKSKIEPGTLEQEEPFVFEGSVLAGNAATGIGSLAGVAAATAVTENEFIMTQNPNPVSQGADGYVVTLPEGYGDGIHTFNLTGPSETTEYDYDVYFYNKNFEIIGSVATSGADETGIVPGGTRYVYVGLYTGADVPFKLTVKRPY

SEQ ID NO: 28866 - protein, 430 aa, Bacillus sp. SG-1
MPFITDVYAREVLDSRGNPTVEVEVYTQSGAFGRALVPSGASTGEYEAVELRDGDKDRYLGKGVQKAVDNVNNEIAEEIIGMDVTDQVAIDRAMMELDGTENKGKLGANAILGVSMAVARAAADFFGVELYQYLGGFNAKQLPVPMMNIVNGGEHADNNVDIQEFMVMPVGAPTFKEGLRMGAEIFHSLKSVLKSKGYNTAVGDEGGFAPNLKSNEEALSTIIEAIEKAGYKPGEEVLLAMDVAASEIYNKEDGKYHLSGEGVVRTSAEMVDWYEEMCNKYPIVSIEDGLDENDWDGHKLLTDRIGNRVQLVGDDLFVTNTNKLSQGIEQGVGNSILIKVNQIGTLTETFDAIEMAKRAGYTAVISHRSGETEDSTIADIAVATNAGQIKTGAPSRTDRVAKYNQLLRIEDQLAHTAQYLGAKTFYNIKK

SEQ ID NO: 28867 - protein, 58 aa, Bacillus subtilis
MKQDMIDYLMKNPQVLTKLENGEASLIGIPDKLIPSIVDIFNKKMTLSKKCKGIFWEQ

SEQ ID NO: 28868 - protein, 596 aa, Bacillus subtilis
MKKVFSNKKFLVFSFIFAMILSLSFFNGESAQASSDKSYKIIGYYPSWGAYGRDFQVWDMDASKVSHINYAFADICWEGRHGNPDPTGPNPQTWSCQDENGVIDVPNGSIVMGDPWIDVQKSNAGDTWDEPIRGNFKQLLKLKKNHPHLKTFISVGGWSWSNRFSDVAADPAARENFAASAVNFLRKYGFDGVDLDWEYPVSGGLPGNSTRPEDKRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIQSNGLSGAMFWDFSGDSNQTLLNKLAADLGFAPGEGNPEPPSSAPGNLRVTEKTATSISLAWDAPSDGANIAEYVLSYEGGAVSVKDTSATIGQLKPNTTYSFTVSAKDADGKLHTGPTIEATTNSDQTCGYNEWKDTAVYTGGDRVVFNGKVYEAKWWTKGEQPDQAGESGVWKLIGDCK

SEQ ID NO: 28869 - protein, 28 aa, Bacillus subtilis
  MOD_RES (8)..(8): Any amino acid
  MOD_RES (16)..(16): Any amino acid
  MOD_RES (21)..(21): Any amino acid
ASGGTVGXYGAWMRSXSLVSXSTITTFS

SEQ ID NO: 28870 - protein, 387 aa, Bacillus subtilis
  strain 168
MQNFTYWNPTKLIFGRGEVERLPEELKPYGKNVLLVYGGGSIKRSGLYDQVIEQLNKAGATVHELAGVEPNPRVSTVNKGVAICKEQNIDFLLAVGGGSVIDCTKAIAAGAKYDGDAWDIVTKKHQPKDALPFGTVLTLAATGSEMNSGSVITNWETKEKYGWGSPLVFPKFSILDPVNTFTVPKNHTIYGMVDMMSHVFEQYFHHVSNTPYQDRMCESLLRTVIETAPKLINDLENYELRETILYTGTIALNGMLSMGARGDWATHNIEHAVSAVYDIPHAGGLAILFPNWMRHTLSENPARMKQLAVRVFDVEEAGKTDEEIALEGIDKLSAFWTSLGAPNRLADYDINDEQLDTIADKAMANGTFGQFKSLNKEDVLSILKASL

SEQ ID NO: 28871 - protein, 332 aa, Bacillus subtilis
  strain 168
MREDTKVYDITIIGGGPVGLFTAFYGGMRQASVKIIESLPQLGGQLSALYPEKYIYDVAGFPKIRAQELINNLKEQMAKFDQTICLEQAVESVEKQADGVFKLVTNEETHYSKTVIITAGNGAFKPRKLELENAEQYEGKNLHYFVDDLQKFAGRRVAILGGGDSAVDWALMLEPIAKEVSIIHRRDKFRAHEHSVENLHASKVNVLTPFVPAELIGEDKIEQLVLEEVKGDRKEILEIDDLIVNYGFVSSLGPIKNWGLDIEKNSIVVKSTMETNIEGFFAAGDICTYEGKVNLIASGFGEAPTAVNNAKAYMDPKARVQPLHSTSLFENK

SEQ ID NO: 28872 - protein, 379 aa, Bacillus subtilis
  strain 168
MKKKTLMIHGGITGDEKTGAVSVPIYQVSTYKQPKAGQHTGYEYSRTANPTRTALEALVTELESGEAGYAFSSGMAAITAVMMLFNSGDHVVLTDDVYGGTYRVMTKVLNRLGIESTFVDTSSREEVEKAIRPNTKAIYIETPTNPLLKITDLTLMADIAKKAGVLLIVDNTFNTPYFQQPLTLGADIVLHSATKYLGGHSDVVGGLVVTASKELGEELHFVQNSTGGVLGPQDSWLLMRGIKTLGLRMEAIDQNARKIASFLENHPAVQTLYYPGSSNHPGHELAKTQGAGFGGMISFDIGSEERVDAFLGNLKLFTIAESLGAVESLISVPARMTHASIPRERRLELGITDGLIRISVGIEDAEDLLEDIGQALENI

SEQ ID NO: 28873 - protein, 395 aa, Bacillus subtilis
  strain 168
MKTVLILNFPAEGHVNPTLGITKAFSDKGYDVHYISTEKYKKRLEAAGATVHLHRDLLRTTPIHVGSPNGILDFVKIHIKTSLDILQIVKDLSKSIQFDFVYYDKFGAGELVRDYLDIPGVSSSASFLFGEEHLKILPLHPESGAPLELDQECEDLLAKMKETYGVAPKNLVQFMNNKGELNVVYTSRYFQPESDRFGDECLFIGPSFPKRAEKTDFPIEQLKDEKVIYISMGTVLDHTEDFFNLCIDAFSGFNGKVVIAAGEKADLTKLKQAPENFIIAPYVPQLEVLEQSDVFITHGGMNSVNEGIHFSVPLVVMPHDKDQPMVAQRLSELHAGYVISKDEVNAQILKQAVDEVLRNDQYTAGIKKINQSFKECMDMEEVMERIDELIRQKNK

SEQ ID NO: 28874 - protein, 169 aa, Bacillus subtilis
  strain 168
MSKKIAVLVTDQFEDIEYTSPVKAYEEAGYSVVAIDLEAGKEVTGKHGEKVKIDKAISDVDASDFDALLIPGGFSPDLLRADDRPGEFAKAFVENKKPVFAICHGPQVLIDTDLLKGKDITGYRSIRKDLINAGANYKDAEVVVSHNIVTSRTPDDLEAFNRESLNLLK

SEQ ID NO: 28875 - protein, 485 aa, Bacillus subtilis
  strain 168
MFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 28876 - protein, 485 aa, Bacillus subtilis
  strain 168
MSLFDHKITELKQLIHKKEIKISDLVDESYKRIQAVDDKVQAFLALDEERARAYAKELDEAVDGRSEHGLLFGMPIGVKDNIVTKGLRTTCSSKILENFDPIYDATVVQRLQDAEAVTIGKLNMDEFAMGSSTENSAYKLTKNPWNLDTVPGGSSGGSAAAVAAGEVPFSLGSDTGGSIRQPASFCGVVGLKPTYGRVSRYGLVAFASSLDQIGPITRTVEDNAFLLQAISGVDKMDSTSANVDVPDFLSSLTGDIKGLKIAVPKEYLGEGVGKEARESVLAALKVLEGLGATWEEVSLPHSKYALATYYLLSSSEASANLARFDGIRYGYRTDNADNLIDLYKQTRAEGFGNEVKRRIMLGTFALSSGYYDAYYKKAQKVRTLIKKDFEDVFEKYDVIVGPTTPTPAFKIGENTKDPLTMYANDILTIPVNLAGVPGISVPCGLADGLPLGLQIIGKHFDESTVYRVAHAFEQATDHHKAKPEL

SEQ ID NO: 28877 - protein, 1130 aa, Bacillus subtilis
  strain 168
MKPIALSIKGLHSFREEQTIDFEGLSGAGVFGIFGPTGSGKSSILDAMTLALYGKVERAANNTHGILNHAEDTLSVSFTFALQTNHQISYKVERVFKRTDEMKVKTALCRFIEIKDEHTVLADKASEVNKRVEELLGLTIDDFTRAVVLPQGKFAEFLSLKGAERRHMLQRLFNLEQYGDRLVKKLRRQAQEANARKNEMLAEQSGLGEASSEAVEQAEKVLEQAEARLEAMRKNRDQAKERFTEHQEIWNVQKEKSTYEEEEKRLAEEQPHIDSMQKRLLEAETAAALKPYADRYAEAIQHEEQAEKEQTLAQKDLADRTAFFQQKHEEYEAWRQHKSEKEPELLAKQEQLSRLQEIEIKLSEAKQEEERKKADLRQKEEALQSVMNELETVTDRLTRGQNRQTELKQQLKSLQVTSDERKSCQQAAEMALRIRQTEEQIKKEKKRSEELNLVLQKMNEEKNTLVQKTEAEENNIIQAYEAVQTVYHLVCETERSLTRMTEEARKSQHTLHLQREKARVALLTKELAQKLTAGKPCPVCGSTDHDPSASVHETYEADSHLEEDIKRTDVLLTEAAALSQEILSAKIMLEEQSARFIEQCPFLQTIQAQNLEAAASFEHQPVYEAFETAKFEWKRIKQDILSVKTRMAQMIGAYQESLKKAEQLNEKIGFEKREADRIESIISELQSSMDSSLNMFKEAFQNQSVDEAEKWQQAIEEKDRAAEECEKRIEKSIAFLAEHEAQKEKLRESGHRLEREKLELHYAAERIKSVIADYEHELGDYAKGDSIQIKLRSVQQDLKLLKEKEQSLYEELQSAQMKLNQAKSRASASELTLQEAKGRLEKAKAAWLEHTKNTSITRTEEVEQSLIPADELEKMKTGIDQFMDKLKQNAANLKRVAEILAGRALSESEWNETVAALQEAEDAFGAAIEEKGAAAKALAVIRDHHKRFNEIEAELKKWQMHIDRLDKLQAVFKGNTFVEFLAEEQLESVARDASARLSMLTRQRYAIEVDSEGGFVMRDDANGGVRRPVSSLSGGETFLTSLSLALALSAQIQLRGEYPLQFFFLDEGFGTLDQDLLDTVVTALEKLQSDNLAVGVISHVQELRARLPKKLIVHPAEPSGRGTRVSLELM

SEQ ID NO: 28878 - protein, 301 aa, Bacillus subtilis
  strain 168
MKFATGELYNRMFVGLIIDDEKIMDLQKAEKKLFELETIPGSLIECIAEGDKFVAHARQLAEWAKKPNDELGSFMYSLSEVKLHAPIPKPSKNIICIGKNYRDHAIEMGSEADIPEHPMVFTKSPVTVTGHGDIVKSHEEVTSQLDYEGELAVVIGKSGTRISKEDAYDHVFGYTIVNDITARDLQKRHKQFFIGKSLDTTCPMGPVLVHKSSIQEPERLKVETRVNGELRQSGSASDMIFSIPELIETLSKGMTLEAGDIIATGTPSGVGKGFTPPKFLRSGDKIDITIDPIGTLSNQIG

SEQ ID NO: 28879 - protein, 588 aa, Bacillus subtilis
  strain 168
MEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPDVNDFFGGDLQGIVDKLDYLEDLGVNGIYLTPIFSAPSNHKYDTLDYFSIDPHFGDPELFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLNGENDPLCRKCMVWEKEKQNQDMLQFMKRLIALRKQENTLLTEGHLEWNLLDDKNDFISFSRTLDEKILIYFFNQGNVVQHVSLRELNIDRNKKICDAWTEQPLQHHDVIAVQPGEFLILSAAAPV

SEQ ID NO: 28880 - protein, 757 aa, Bacillus subtilis
  strain 168
MINQRLFEIDEWKIKTNTFNKEHTRLLESLTSLANGYMGVRGNFEEGYSGDSHQGTYIAGVWFPDKTRVGWWKNGYPEYFGKVINAMNFMGIGLYVDGEKIDLHQNPIELFEVELNMKEGILRRSAVVRIQDKTVRIRSERFLSLAVKELCAIHYEAECLTGDAVITLVPYLDGNVANEDSNYQEQFWQEEAKGADSHSGHLAAKTIENPFGTPRFTVLAAMANETEGFVHESFKTTEMYVENRYSYQTKASLKKFVIVTTSRDFREEELLSKAKELLADVVENGYEDAKRRHTDRWKERWAKADIEIKGDEELQQGIRYNIFQLFSTYYGGDARLNIGPKGFTGEKYGGAAYWDTEAYAVPMYLATAEPEVTKNLLLYRYHQLEAAKRNAAKLGMKGALYPMVTFTGDECHNEWEITFEEIHRNGAICYAIYNYINYTGDRNYMEEYGIDVLVAVSRFWADRVHFSKRKNKYMIHGVTGPNEYENNVNNNWYTNVIAAWTLEYTLQSLESISAEKRRHLDVQEVELEVWREIIQHMYYPFSEELQIFVQHDTFLDKDLQTVDELDPAERPLYQNWSWDKILRSNFIKQADVLQGIYLFNDRFTMEEKRRNFEFYEPMTVHESSLSPSVHAILAAELKLEKKALELYKRTARLDLDNYNHDTEEGLHITSMTGSWLAIVHGFAGMRTANETLSFAPFLPKEWDEYSFNINYRNRLINVTVDEKRVIFELVKGEPLHMNVYEEPVVLQGRCERRTPNE

SEQ ID NO: 28881 - protein, 561 aa, Bacillus subtilis
  strain 168
MSEWWKEAVVYQIYPRSFYDANGDGFGDLQGVIQKLDYIKNLGADVIWLSPVFDSPQDDNGYDISDYKNMYEKFGTNEDMFQLIDEVHKRGMKIVMDLVVNHTSDEHAWFAESRKSKDNPYRDYYLWKDPKPDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHEFIQEMNREVLSHYDCMTVGEANGSDIEEAKKYTDASRQELNMIFTFEHMDIDKEQNSPNGKWQIKPFDLIALKKTMTRWQTGLMNVGWNTLYFENHDQPRVISRWGNDRKLRKECAKAFATVLHGMKGTPFIYQGEEIGMVNSDMPLEMYDDLEIKNAYRELVVENKTMSEKEFVKAVMIKGRDHARTPMQWDAGKHAGFTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 28882 - protein, 479 aa, Bacillus subtilis
  strain 168
MAMKIGTDAFKERVSQGIDNEFMRGAVSGAQERLRTRRLEAAEELGNWEEWRSLSEEIRQHVLENLDFYLGQLAENVAKRGGHVYFAKTAEEASSYIRDVIQKKNGKKIVKSKSMVTEEINLNEVLEKEGCEVVETDLGEYILQIDDHDPPSHIVAPALHKNKEQIRDVFKERLDYQHTEKPEELVMHARAILRKKFLEADIGITGCNFAIADTGSVSLVTNEGNGRLVSTLPKTQITVMGMERIVPSFSEFEVLVSMLTRSAVGQRLTSYITALTGPKLEGEVDGPEEFHLVIVDNGRSNILGTEFQSVLQCIRCAACINVCPVYRHVGGHSYGSIYSGPIGAVLSPLLGGYDDYKELPYASSLCAACSEACPVKIPLHELLLKHRQNIVEKEGRAPISEKLAMKAFGLGASSLSLYKMGSKWAPAAMTPFTEDEKISKGPGPLKNWTQIRDFPAPHKSRFRDWFADRETSERTKEEQ

SEQ ID NO: 28883 - protein, 174 aa, Bacillus subtilis
  strain 168
MNMLVINGTPRKHGRTRIAASYIAALYHTDLIDLSEFVLPVFNGEAEQSELLKVQELKQRVTKADAIVLLSPEYHSGMSGALKNALDFLSSEQFKYKPVALLAVAGGGKGGINALNNMRTVMRGVYANVIPKQLVLDPVHIDVENATVAENIKESIKELVEELSMFAKAGNPGV

SEQ ID NO: 28884 - protein, 282 aa, Bacillus subtilis
  strain 168
MRQTRGEASPSAVSLAFKFASLAVLCVLLLLMVILGYSNSSTKAKEVTVTTNGQLRDEKESLKLKNDSPDLLIKHLQTKQNMGDKTVYLTFDDGPSAVTTRLLDVLKSADVKATFFMLSPRMNEFKQAVKRAEKEGHALGLHGVTHNNRLFYQTPTSPLKEMQEARDTLQDITGYKTDLVRTPYGSKPSLTASQIRNLEKDGFVYWDWTIDSMDWKYRNSQYVTAVLQQLENMEHSSSSRPNVILMHDLPATVNALPVLINKLKEKGYSFGVLEDTMVPVHE

SEQ ID NO: 28885 - protein, 282 aa, Bacillus subtilis
  strain 168
MKVLVNGRLIGRSEASIDLEDRGYQFGDGIYEVIRVYKGVLFGLREHAERFFRSAAEIGISLPFSIEDLEWDLQKLVQENAVSEGAVYIQTTRGVAPRKHQYEAGLEPQTTAYTFTVKKPEQEQAYGVAAITDEDLRWLRCDIKSLNLLYNVMTKQRAYEAGAFEAILLRDGVVTEGTSSNVYAVINGTVRTHPANRLILNGITRMNILGLIEKNGIKLDETPVSEEELKQAEEIFISSTTAEIIPVVTLDGQSIGSGKPGPVTKQLQAAFQESIQQAASIS

SEQ ID NO: 28886 - protein, 396 aa, Bacillus subtilis
  strain 168
MSISTLQKEINKQLDGCFEEMVEIRRHFHMYPELSFQEEKTAAFIASYYESLGVPIRTNVGGRGVLANIEGSEPGPTVALRADFDALPIQDEKDVPYASKVPGVMHACGHDGHTAALLAVAKVLHQNRHELKGTFVMIHQHAEEYYPGGAKPMIDDGCLENTDVIFGTHLWATEPLGTILCRPGAVMAAADRFTIKVFGKGGHGAHPHDTKDAVLIGSQIVSSLQHIVSRKVNPIQSAVISTGSFIADNPFNVIADQAVLIGTARSFDENVRDILEKEIEAVVKGICSMHGASYEYTYEQGYPAVVNHPAETNHLVSTAKNTEGVQQVIDGEPQMGGEDFAYYLQNVKGTFFFTGAAPEQPERVYSHHHPKFDINEKAMLTAAKVLAGAAITYHQL

SEQ ID NO: 28887 - protein, 346 aa, Bacillus subtilis
  strain 168
MTSVRKTMELIKELVSIPSPTGNTYEVINYIESLLKEWKVETVRNHKGGLIATLPGRDTSRHRMLTAHVDTLGAMVKEIKADGRLKIDLIGGFRYNSIEGEYCQIETASGKMYTGTILMHQTSVHVYKDAGKAERNQENMEIRLDEPVHCRKDTEELGIGVGDFVSFDPRVEITSSGFIKSRHLDDKASVALLLRLIHEIQTEDIELPYTTHFLISNNEEIGYGGNSNIPPETVEYLAVDMGAIGDGQATDEYSVSICVKDASGPYHYQLRKHLVQLAEKHHIDYKLDIYPYYGSDASAAIKSGHDIVHGLIGPGIDASHAFERTHKSSLRHTAKLLYYYVQSPMV

SEQ ID NO: 28888 - protein, 244 aa, Bacillus subtilis
  strain 168
MKVTVIGCYGGFPAANEATSGYLFQSGDYSLLVDCGSAVLSKLFGYVPAEKLDAVVLSHYHHDHIADIGPLQFAKQVGSFLGKGEHTLPIYGHDADIEQFQKLTYKTHTKGIAYQPDQPLTAGPFTITFLKTIHPVTCYAMRITDGSHTVVYTADSSYQDSFIPFSKDADLLISECNFYADQDGTSAGHMNSLEAGRIAKEAGAGELLLTHLPHFGVHDNLRKEAKTVFNGEVNIAKSGFVWEG

SEQ ID NO: 28889 - protein, 331 aa, Bacillus subtilis
  strain 168
MLFIDNQNINDPRINLAIEEYCVKHLDPEQQYLLFYVNQPSIIIGKNQNTIEEINTKYVEENGIIVVRRLSGGGAVYHDLGNLNFSFITKDDGDSFHNFKKFTEPVIQALHQLGVEAELSGRNDIVVDGRKISGNAQFATKGRIFSHGTLMFDSAIDHVVSALKVKKDKIESKGIKSIRSRVANISEFLDDKMTTEEFRSHLLRHIFNTNDVGNVPEYKLTEKDWETIHQISKERYQNWDWNYGRSPKFNLNHSKRYPVGSIDLHLEVKKGKIEDCKIFGDFFGVGDVSEIENLLVGKQYERSVIADVLEGVNLKHYFGNITKEDFLDLIY

SEQ ID NO: 28890 - protein, 333 aa, Bacillus subtilis
  strain 168
MKLLKREGLSLTEEKALWMYQKMLEIRGFEDKVHELFAQGVLPGFVHLYAGEEAVAVGVCAHLHDGDSITSTHRGHGHCIAKGCDLDGMMAEIFGKATGLCKGKGGSMHIADLDKGMLGANGIVGGGFTLACGSALTAKYKQTKNVSVCFFGDGANNQGTFHEGLNLAAVWNLPVVFVAENNGYGEATPFEYASACDSIADRAAAYNMPGVTVDGKDILAVYQAAEEAIERARNGGGPSLIECMTYRNYGHFEGDAQTYKTKDERVEHLEEKDAIQGFKNYLLKETDANKLSDIEQRVSESIEKAVSFSEDSPYPKDSELLTDVYVSYEKGGM

SEQ ID NO: 28891 - protein, 394 aa, Bacillus subtilis
  strain 168
MRLNRQFIRTQLIAQNILSKNAPAKRENATENPAAVLEKAYSRLKSQSSTGGINQFNYSKTSVSGNSGTFSKVYQSANDRTVTDTGEETVIQSQNPYESESDIRIKILDEKYSRMNAINKTKSDPLGYIKDKYQNSKSPYFRSDLSAAERQAAYDNETEWLFKGKAQNYNLQDAVFRNVTFHGEVEAENEKVYQRGQVNQQLQVLLNRNHIHIPEGTELTFTITPIDYQVRVSGTDDQDLIKQIEQVLQSGDNSKELFLHIMKSQSSDSAQFSEEAYKKYQAAREMYEVTGYHLKDLEVIDGRYVTPEGRDLMDVYKEELEKDPVQKQTASYAISYYRSELSKIAEAGYNAIPDFILSIDYSNGSLRDVGQSKSYGTGDTGWLEALKRQTGVNY

SEQ ID NO: 28892 - protein, 398 aa, Bacillus subtilis
  strain 168
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 28893 - protein, 194 aa, Bacillus subtilis
  strain 168
MPQTEQIHQHSVLRDIIRSRRSIRKFKQEPVPSAVILDMLETAKYAPNHRVTEPWRFIYVSSETGKANLINTFAAFSKKSKPDMTEEKLQNFKNTLGRVPGFLLVVFQEDENERARDDDFAATSSLIQNLQLLAWEKGIGMVWKSGKILYDKEVHQAFGLQDNERFAAIIQTGYPDEAPEVKKRTPIRDRFTEM

SEQ ID NO: 28894 - protein, 670 aa, Bacillus subtilis
  strain 168
MKGTKGKVFRVFTAFLAFVLFITAYDLTKGSEKPEDIHNTSLLRNSCFFNWLESKKTRGITMAEEKKANQLPDRSEVKAEDTWRLEDIFPSDEAWNKEFQAVKELIPNLSKYKGKLADSADHLYEALTYQDKVMERLGRLYTYAHMRSDQDTGNSFYQGLNDKAGNLYTQAASATAYLVPEILSIEEDKLQQFILEKEELKLYSHAIEEITKERPHVLSEKEEALLAEASEVLGSSSNTFSVLNNADITFPSIKDEDGNEKQITHGNFINFLESENREVRKNAFDAVYKTYGQYKNTMATTLSGTVKKDNFYARVKKYKSAREAALSNNSIPEEVYDNLVKTINKHLPLLHRYIALRKKVLELDEVHIYDLYTPLVKDAGMKVTYEEAKDYMLKGLAPLGEEYASILKEGLENRWVDVYENKGKRNGAYSSGAYGTNPYILMNWHNNVNNLFTLVHEFGHSVHSYYTRKHQPYPYGNYSIFVAEVASTTNEALLGEYLLNNLEDEKQRLYILNHMLEGFRGTVFRQTMFAEFEHLIHTKAQEGEPLTPELLTNVYYDLNKKYFGDGMVIDKEIGLEWSRIPHFYYNYYVYQYATGYSAAQALSSQILKEGKPAVDRYIDFLKAGSSQYPIDVLKKAGVDMTSPEPIEAACKMFEEKLDEMEELLMKVKQS

SEQ ID NO: 28895 - protein, 171 aa, Bacillus subtilis
  strain 168
MKYGIVLFPSKKLQDLANSYRKRYDPSYSLIPPHLTLRASFECAEEKADQLVSHLRNIAKESHPLVLKMTKYSSFAPVNNVIYIKAEPTEELKTLNEKLYTGVLAGEQEYNFVPHVTVGQNLSDDEHSDVLGQLKMQEVSHEEIVDRFHLLYQLENGSWTVYETFLLGRGE

SEQ ID NO: 28896 - protein, 564 aa, Bacillus subtilis
  strain 168
MRQSLTLIPTLREVPADAEAKSHQLLLRAGFIRQNTSGVYSYMPLAYKVIQNIQQIVREEMEKIDAVEMLMPALQQAETWQESGRWYTYGPELMRLKDRHGREFALGATHEEVITSLVRDEVKSYKRLPLTLYQIQSKFRDEKRPRFGLLRGREFIMKDAYSFHASAESLDETYQKMYEAYSNIFARCGINVRPVIADSGAMGGKDTHEFMALSAIGEDTIAYSDESQYAANIEMAEVLHQEVPSDEEPKALEKVHTPNVKTIEELTAFLQVSAEACIKSVLFKADDRFVLVLVRGDHEVNDIKVKNLLHAEVVELATHEEVIQQLGTEPGFVGPVGIHQDVEVYADQAVKAMVNAVAGANEGDHHYKNVNVNRDAQIKEFADLRFIKEGDPSPDGKGTIRFAEGIEVGQVFKLGTRYSEAMNATYLDENGRAQPMLMGCYGIGVSRTLSAIAEQHHDEKGLIWPKSVAPYDLHILALNMKNDGQRELAEKLYADLKAEGYEVLYDDRAERAGVKFADSDLIGLPIRITVGKRADEGIVEVKIRQTGESTEISVDELSAFISKQ

SEQ ID NO: 28897 - protein, 555 aa, Bacillus subtilis
  strain 168
MKKKNTENVRIIALGGVGEIGKNLYVIEIDSDIFVVDAGLMHPENEMLGIDVVIPDISYLIERADRVKAIFLTHGHDENIGGVFYLLNKLSVPVYGTKLTLALLREKLKQYGHNRKTDLREIHSKSVITFESTKVSFFRTIHSIPDSVGVSFKTSLGSIVCTGDFKFDQTPALNQTCDIGEIAKIGNSGVLALLSDSANAERPGYTPSEAAVSGEISDALYNSQNRVIIAVFASNINRIQQVIHAAAQNGRKIAVAGKNLQSVLQLARKLGYIEADDELFISVQDVKKYPKREVAIITAGSQGEPLAALTRMANKAHKQLNIEEGDTVVIASTPIPGQELIYSKTVDLLARAGAQVIFAQKRVHVSGHGSQEELKLMINLLKPKYLIPVNGEYRMQKAHSKIAEETGMKRSDIFLIEKGDVVEFRGQNVKIGDKVPYGNILIDGLGVGDIGNIVLRDRRLLSQDGILIVVITLDKQKKHLVSGPEIITRGFVYVRESEGLIVQATELVRSIVTEATETSNVEWSTLKQAMRDALNQFLYEKTKRKPMIIPIIMEV

SEQ ID NO: 28898 - protein, 426 aa, Bacillus subtilis
  strain 168
MSYVNELKSKHGGLTAHIVKTEKFKTVSLIFKMLAPLTKDQVTKRALLPHVLLRGTKSHPKTAGLRSYLDELYGTSVSADLTKKGERHVITFRLEIPNEKYLKDQTPLLEKGLQLLAELVFSPALEGDAFQSQYVAQEKRTLKQRIQAVYDDKMRYSNLRLIQEMCKNDPYALHVNGEIDDVDDITAEQLYETYQSAIQKDQLDLYVVGDVDSNQVQSAIDKYFKTEERTLGMIENNHADEKVQPKEVIDEEDVKQGKLNIGYRTSITYTDQDYPALQVFNGLFGGFSHSKLFINVREKASLAYYAASRIESFKGLLMVMSGIEVKNFEQAVSIIAEQFQAMKNGDFSEQDIAQTKAVIRNQVLETIDTAYGLSEFLYQQAAAQVEIPIEDFLANIENVTKEDIIKAGEKIQLDTTYFLKGTEGAS

SEQ ID NO: 28899 - protein, 428 aa, Bacillus subtilis
  strain 168
MIKPIEYEQLQETLYHEKMSNGLDVYVLPKKGFNKTYAVFTTKYGSIDNRFVPLGKNEMVHVPDGIAHFLEHKLFEKADGDVFQDFSKQGASANAFTSFTRTAYLFSSTSNVERNLETLIDFVQDPYFTEKTVEKEKGIIGQEINMYDDNPDWRLYFGVIENMYKEHPVRIDIAGTVESISHITKDLLYECYETFYHPSNMLLFIVGPVDPEAIISQVRENQGKKPYTDQPEIKREEVKEQEAVFRKEKEIKMNVQGPKCLVGLKSKNPFKLGKELLKHELSMNLLLEALFGKSSAQYESLYEKGYIDETFSFDFTAEYGFGFAAIGGDTPEPDQLAEDISSMLLRAGELITAEKIELARKKKIGTFLKALNSPEYIANQFTRYAFLDMSLFDVVTVLEQITLEDVQNVIQEEIAADRLTVCKVVPKS

SEQ ID NO: 28900 - protein, 288 aa, Bacillus subtilis
  strain 168
MSLDDLQAATKIQKRYLTALEEGNYDIIPGKFYVRAFIKQYAEAVGLDADQLFEEHKKDIPNTYHDDVSEKISGMNLQKEMPKPASKALELLPTILVILGVIVVIAIVYAIIQFANHKNSDDHNAASEKAITQSESKYEIPKDSTLKENQNNSSEKETDTKKETKENEDKKKENDSEKLEIKAAGTEGSLTTYEVSGADKIELELKASDSSWIRVRDENSSSLKEGTLKKDETYKKDITDQKQVDIRTGYAPNLKIKINGKVLSYELDPKKVMAQTIKIVNKKEEKSS

SEQ ID NO: 28901 - protein, 73 aa, Bacillus subtilis
  strain 168
MKPINIQDQFLNQIRKENTYVTVFLLNGFQLRGQVKGFDNFTVLLESEGKQQLIYKHAISTFAPQKNVQLELE

SEQ ID NO: 28902 - protein, 118 aa, Bacillus subtilis
  strain 168
MISTSNYDVTKDPKFLAFCSLATEGYGQNNTQQSSIGFNEFCEKLEKNAIVKPENKKSTLDLNKSLEDWKLRFTAGGNLSTMDSQVLDVIKKAYNLGMVNKDNMLLRNEAINAYRNSI

SEQ ID NO: 28903 - protein, 154 aa, Bacillus subtilis
  strain 168
MTKRGIQAFAGGIILATAVLAAVFYLTDEDQAAAVKDNKTVTEQDVNNYLDSKKLVSVNRDEYQKLLDSKEKSLNNDSGSDTKSDKVKTYKLTIKDGMSTADVSAILEKEGIISSAQDFNDYVIDAGYHKEIRAGEFKVKSDMSFKKIVKTLTR

SEQ ID NO: 28904 - protein, 424 aa, Bacillus subtilis
  strain 168
MGYNIPRGTQDILPGESDRWQFVEQIMRDTCRTYQYKEIRTPIFEHTELFARGVGESTDIVQKEMYTFEDRKGRSLTLRPEGTAAAVRAFNENKLFANPVQPTKLYYVGPMFRYERPQTGRYRQFYQFGIEAIGSKDPAIDAEVMALAMSIYEKAGLENVKLVINSLGDQDSRKSYREALVKHFEPRIEEFCSDCQSRLHTNPLRILDCKKDRDHELMKSAPSILTYLNEESAAYFEKVKQYLNDLGISYEIDPNLVRGLDYYNHTAFEIMSNAEGFGAITTLAGGGRYDGLVEQIGGPEAPGIGFAMSIERLLAAIDAEKRELPVDKGIDCYIVTLGEKAKDYSVSLVYKLREAGISSEIDYENKKMKGQFKTADRLKARFIAILGEDELAQNKINVKDAQTGEQIEVALDEFIHVMKANQKG

SEQ ID NO: 28905 - protein, 500 aa, Bacillus subtilis
  strain 168
MFYAVQQSEHTETLVVGLFQKSQLTGKALEIDEMLEGHLTQLLKEGDVSAKPNQVSKVFPPSSAGMKRIYFVGLGREANYSFEQAKERFAHVFQAIHKDRKQETAVLLDTFISEDVPPADAAHALAESCLLASYEVQDYKHKSNEPDKQIEAVYVVTDEDTQEVQAGLRVGQAYGQGTNSARTLVNMPGNMLTATDLASYAEELAAKYDFECEILEKSEMEELGMGGILAVNQGSTEPPKMIVLKYQGKKEWEDVVGLVGKGITFDTGGYSIKTKSGIVGMKSDMGGAAAVLGAMETIGELRPEQNVLCVIPSTDNMISGGAMKPDDVIVSLSGKTIEILNTDAEGRLVLADGITYAKQHGASVLVDVATLTGGVVVALGTETTGAMTNDQSFYQQVADAAQECGEAIWQLPITEKDKKRVKSSQMADLSNSPGREGHAIMAGTFLGEFAESTPWVHLDIAGTATANKATCFGPAGATGVMARTLATLAERFTLEEDKNE

SEQ ID NO: 28906 - protein, 465 aa, Bacillus subtilis
  strain 168
MAKKMPDIGEYKYGFHDKDVSIFRSERGLTKEIVEEISRMKEEPQWMLDFRLKSLEHFYNMPMPQWGGDLNSLNFDEITYYVKPSERSERSWDEVPEEIKQTFDKLGIPEAEQKYLAGVSAQYESEVVYHNMKEDLEAQGIVFKDTDSALKENEDIFREHWAKVIPPTDNKFAALNSAVWSGGSFIYVPKGVKVETPLQAYFRINSENMGQFERTLIIVDEEASVHYVEGCTAPVYTTNSLHSAVVEIIVKKGGYCRYTTIQNWANNVYNLVTKRTVCEENATMEWIDGNIGSKLTMKYPACILKGEGARGMTLSIALAGKGQHQDAGAKMIHLAPNTSSTIVSKSISKQGGKVTYRGIVHFGRKAEGARSNIECDTLIMDNKSTSDTIPYNEILNDNISLEHEAKVSKVSEEQLFYLMSRGISEEEATEMIVMGFIEPFTKELPMEYAVEMNRLIKFEMEGSIG

SEQ ID NO: 28907 - protein, 437 aa, Bacillus subtilis
  strain 168
MTLGTKLSVDQEYLKSFSEKHQEPAWLKNLRLQALEQAEDLPMPKPDKTKITNWNFTNFAKHTVDNEPLSSLEDLTDEVKALIDIENEDKTLYVQRDQTPAHLSLSQELKDKGVIFTDILTAAREHSDLVEKYFMKDGVKVDEHKLTALHAALVNGGAFLYVPKNVQVETPVQAVYVHESNDTALFNHVLIVAEDHSSVTYVENYISTVNPKDAVFNIISEVITGDNASVTYGAVDNLSSGVTTYVNRRGAARGRDSKIEWALGLMNDGDTISENTTNLYGDGTYGDTKTVVVGRGEQTENFTTQIIHFGKASEGYILKHGVMKDSASSIFNGIGKIEHGASKANAEQESRVLMLSEKARGDANPILLIDEDDVTAGHAASVGRVDPIQLYYLMSRGIPKEEAERLVIYGFLAPVVNELPIEGVKKQLVSVIERKVK

SEQ ID NO: 28908 - protein, 276 aa, Bacillus subtilis
  strain 168
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 28909 - protein, 571 aa, Bacillus subtilis
  strain 168
MVTKILKAPDGSPSDVERIKKESDYLRGTLKEVMLDRISAGIPDDDNRLMKHHGSYLQDDRDLRNERQKQKLEPAYQFMLRVRMPGGVSTPEQWLVMDDLSQKYGNGTLKLTTRETFQMHGILKWNMKKTIQTIHSALLDTIAACGDVNRNVMCASNPYQSEIHSEVYEWSKKLSDDLLPRTRAYHEIWLDEERVAGTPEEEVEPMYGPLYLPRKFKIGIAVPPSNDIDVFSQDLGFIAIVEDGKLIGFNVAIGGGMGMTHGDTATYPQLAKVIGFCRPEQMYDVAEKTITIQRDYGNRSVRKNARFKYTVDRLGLENVKEELENRLGWSLEEAKPYHFDHNGDRYGWVEGIEDKWHFTLFVEGGRITDYDDYKLMTGLREIAKVHTGEFRLTANQNLMIANVSSDKKEEISALIEQYGLTDGKHYSALRRSSMACVALPTCGLAMAEAERYLPTLLDKIEEIIDENGLRDQEITIRMTGCPNGCARHALGEIGFIGKAPGKYNMYLGAAFDGSRLSKMYRENIGEADILSELRILLSRYAKEREEGEHFGDFVIRAGIIKATTDGTNFHD

SEQ ID NO: 28910 - protein, 605 aa, Bacillus subtilis
  strain 168
MQLQVMNSPFNQEQAELLNRLLPTLTESQKIWLSGYLSAQSVSAQEAAGTPAAAVSAEAPAPAVSKEVTVLYGSQTGNAQGLAENAGKQLEQSGFQVTVSSMSDFKPNQLKKVTNLLIVVSTHGEGEPPDNALSFHEFLHGRRAPKLEDLRFSVLALGDSSYEFFCQTGKEFDQRLEELGGKRISPRVDCDLDYDEPAAEWLEGVLKGLNEAGGGSAAPAPAAASQTGESSYSRTNPFRAEVLENLNLNGRGSNKETRHVELSLEGSGLTYEPGDSLGVYPENDPELVELLLKEMNWDPEEIVTLNKQGDVRPLKEALISHYEITVLTKPLLEQAAQLTGNDELRELLAPGNEENVKAYIEGRDLLDLVRDYGPFSVSAQEFVSILRKMPARLYSIASSLSANPDEVHLTIGAVRYDAHGRERKGVCSILCAERLQPGDTLPVYVQHNQNFKLPKDPETPIIMVGPGTGVAPFRSFMQEREETGAEGKAWMFFGDQHFVTDFLYQTEWQNWLKDGVLTKMDVAFSRDTEEKVYVQHRMLEHSAELFEWLQEGAAVYICGDEKHMAHDVHNTLLEIIEKEGNMSREEAEAYLADMQQQKRYQRDVY

SEQ ID NO: 28911 - protein, 358 aa, Bacillus subtilis
  strain 168
MITLLKGRRKVDTIKVGILGYGLSGSVFHGPLLDVLDEYQISKIMTSRTEEVKRDFPDAEVVHELEEITNDPAIELVIVTTPSGLHYEHTMACIQAGKHVVMEKPMTATAEEGETLKRAADEKGVLLSVYHNRRWDNDFLTIKKLISEGSLEDINTYQVSYNRYRPEVQARWREKEGTATGTLYDLGSHIIDQTLHLFGMPKAVTANVMAQRENAETVDYFHLTLDYGKLQAILYGGSIVPANGPRYQIHGKDSSFIKYGIDGQEDALRAGRKPEDDSWGADVPEFYGKLTTIRGSDKKTETIPSVNGSYLTYYRKIAESIREGAALPVTAEEGINVIRIIEAAMESSKEKRTIMLEH

SEQ ID NO: 28912 - protein, 211 aa, Bacillus subtilis
  strain 168
MAKVLYITAHPHDEATSYSMATGKAFIESYKEANPNDEVVHIDLYKENIPHIDADVFSGWGKLQSGTGFEELSESEKAKVGRLGELSDQFASADKYVFVTPLWNFSFPPVMKAYLDSVAVAGKSFKYTEQGPVGLLTDKKAIHIQARGGYYSEGPAAEMEMGHRYIGIMMNFFGVPSFDGIFVEGHNAEPDKAQQIKEDAIARAKEAGKTF

SEQ ID NO: 28913 - protein, 458 aa, Bacillus subtilis
  strain 168
MTLAIIGGGPAGYAAAVSAAQQGRNVLLIDKGKLGGTCLNEGCIPTKSLLESANVLDKIKHADSFGIELPAGAISVDWSKMQSRKQQVVSQLVQGVQYLMKKNQIQVVKGTASFLSERKLLIEGENGKEIREADQVLIASGSEPIELPFAPFDGEWILDSKDALSLSEIPSSLVIVGGGVIGCEYAGLFARLGSQVTIIETADRLIPAEDEDIARLFQEKLEEDGVEVHTSSRLGRVDQTAKTAIWKSGQREFKTKADYVLVAIGRKPRLDGLQLEQAGVDFSPKGIPVNGHMQTNVPHIYACGDAIGGIQLAHAAFHEGIIAASHASGRDVKINEKHVPRCIYTSPEIACIGMTERQARSIYGDVKIGEFSFSANGKALIKQQAEGKVKIMAEPEFGEIVGVSMIGPDVTELIGQAAAIMNGEMTADMAEHFIAAHPTLSETLHEALLSTIGLAVHA

SEQ ID NO: 28914 - protein, 154 aa, Bacillus subtilis
  strain 168
MCQSNQIVSHFLSHRNVTNELAEKISKDHYSYKPAETSMSAEELVKHILTSFHLFANVIKEGNASPFQNKQEETETDLNVLAKTYTEKTVAILEQLTEEQLDREIDLTSAFGRKVTGRALLQLAMEHEIHHKGNLFVYVREMGHTELPFYQQRM

SEQ ID NO: 28915 - protein, 413 aa, Bacillus subtilis
  strain 168
MTKKRVVVTGLGALSPLGNDVDTSWNNAINGVSGIGPITRVDAEEYPAKVAAELKDFNVEDYMDKKEARKMDRFTQYAVVAAKMAVEDADLNITDEIAPRVGVWVGSGIGGLETLESQFEIFLTKGPRRVSPFFVPMMIPDMATGQISIALGAKGVNSCTVTACATGTNSIGDAFKVIQRGDADVMVTGGTEAPLTRMSFAGFSANKALSTNPDPKTASRPFDKNRDGFVMGEGAGIIVLEELEHALARGAKIYGEIVGYGSTGDAYHITAPAQDGEGGARAMQEAIKDAGIAPEEIDYINAHGTSTYYNDKYETMAIKTVFGEHAHKLAVSSTKSMTGHLLGAAGGIEAIFSILAIKEGVIPPTINIQTPDEECDLDYVPDEARRQELNYVLSNSLGFGGHNATLIFKKYQS

SEQ ID NO: 28916 - protein, 449 aa, Bacillus subtilis
  strain 168
MDNYRDENRTKGNENEVFLTKENDQSASYSARNVIHDQEKKKRGFGWFRPLLGGVIGGSLALGIYTFTPLGDHDSQDTAKQSSSQQQTQSVTATSTSSESKKSSSSSSAFKSEDSSKISDMVEDLSPAIVGITNLQAQSNSSLFGSSSSDSSEDTESGSGSGVIFKKENGKAYIITNNHVVEGASSLKVSLYDGTEVTAKLVGSDSLTDLAVLQISDDHVTKVANFGDSSDLRTGETVIAIGDPLGKDLSRTVTQGIVSGVDRTVSMSTSAGETSINVIQTDAAINPGNSGGPLLNTDGKIVGINSMKISEDDVEGIGFAIPSNDVKPIAEELLSKGQIERPYIGVSMLDLEQVPQNYQEGTLGLFGSQLNKGVYIREVASGSPAEKAGLKAEDIIIGLKGKEIDTGSELRNILYKDAKIGDTVEVKILRNGKEMTKKIKLDQKEEKTS

SEQ ID NO: 28917 - protein, 192 aa, Bacillus subtilis
  strain 168
MAIQLSKGQRIDLTKTNPGLTKAVIGLGWDTNKYSGGHDFDLDASAFLVDAHDNCVNDLDFVFYNNLEHPSGGVIHTGDNRTGEGDGDDEQIIVDFSKIPAHIEKIGITVTIHDAEARSQNFGQVSNAFVRVVDEETQNELLRFDLGEDFSIETAVVVCELYRHGGEWKFNAIGSGFSGGLAALCRNYGLQV

SEQ ID NO: 28918 - protein, 340 aa, Bacillus subtilis
  strain 168
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 28919 - protein, 396 aa, Bacillus subtilis
  strain 168
MAESLLIKDIAIVTENEVIKNGYVGINDGKISTVSTERPKEPYSKEIQAPADSVLLPGMIDIHIHGGYGADTMDASFSTLDIMSSRLPEEGTTSFLATTITQEHGNISQALVNAREWKAAEESSLLGAELLGIHLEGPFVSPKRAGAQPKEWIRPSDVELFKKWQQEAGGLIKIVTLAPEEDQHFELIRHLKDESIIASMGHTDADSALLSDAAKAGASHMTHLYNAMSPFHHREPGVIGTALAHDGFVTELIADGIHSHPLAAKLAFLAKGSSKLILITDSMRAKGLKDGVYEFGGQSVTVRGRTALLSDGTLAGSILKMNEGARHMREFTNCSWTDIANITSENAAKQLGIFDRKGSVTVGKDADLVIVSSDCEVILTICRGNIAFISKEADQI

SEQ ID NO: 28920 - protein, 221 aa, Bacillus subtilis
  strain 168
MADLKTQILDAYNFRHATKEFDPNKKVSDSDFEFILETGRLSPSSLGLEPWKFVVVQNPEFREKLREYTWGAQKQLPTASHFVLILARTAKDIKYNADYIKRHLKEVKQMPQDVYEGYLSKTEEFQKNDLHLLESDRTLFDWASKQTYIALGNMMTAAAQIGVDSCPIEGFQYDHIHRILEEEGLLENGSFDISVMVAFGYRVRDPRPKTRSAVEDVVKWV

SEQ ID NO: 28921 - protein, 349 aa, Bacillus subtilis
  strain 168
MTKYIGYVGTYTKGGSEGIYSFELDTEKKALSEPKLAAKLGNPTYVATNKNNTILYSIEKADGQGGVAAYQIDKNSGELTFLNHQLIDGPSPCHVSVDDQNQFVLTANYHSGKVHVFPVQEDGSLQSPVSEAAHTGKGPHERQEKPHTHYAGFTPEHNYVVAVDLGIDKLYTYKLKDGVLTESGSHSFAPGAGPRHIAFHPKEKYAYVMTELSNEVIALEYNPTAGEFREIQVVSAIPDDFTDNSQGSAIHVTQDGRFVYVANRGHDSIAVFEVNQYSGELAFVERVSTEGNWPRDFVFDPTEGFLVASNEETGNLVLFERDKETGRLTLLPSTVSVPYPVCVKFLHQV

SEQ ID NO: 28922 - protein, 878 aa, Bacillus subtilis
  strain 168
MKHLTSAEVRQMFLDFFKEKGHAVEPSASLVPHEDPSLLWINSGVATLKKYFDGRVVPENPRIVNAQKAIRTNDIENVGKTARHHTFFEMLGNFSIGDYFKEEAITWAWEFLTSDKWIGFDKELLSVTVHPEDEEAYEFWAKKIGIPEERIIRLEGNFWDIGEGPSGPNTEIFYDRGEAYGNDPEDPELYPGGENDRYLEVWNLVFSEFNHNPDGTYTPLPKKNIDTGMGLERMVSVIQNVPTNFDTDLFVPIIKATESISGETYGKDNVKDTAFKVIADHIRTVAFAVSDGALPSNEGRGYVLRRLLRRAVRYAKTINIHRPFMFDLVPVVAEIMADFYPEVKEKADFIAKVIKTEEERFHETLNEGLAILSEMIKKEKDKGSSVISGADVFKLYDTYGFPVELTEEYAEDENMTVDHEGFEEEMNQQRERARNARQDVGSMQVQGGALRDVTVESTFVGYSQTKADANIIVLLQDGQLIEEAHEGESVQIILDETPFYAESGGQIGDKGYLRSEQAVVRIKDVQKAPNGQHVHEGVVESGTVQKGLHVTAEVEDHMRSGVIKNHTATHLLHQALKDVLGTHVNQAGSLVTENRLRFDFSHFGQVTKEELEQIERIVNEKIWASIPVSIDLKPIAEAKEMGAMALFGEKYGDIVRVVQVGDYSLELCGGCHVRNTAEIGLFKIVSESGIGAGTRRIEAVTGQGAYVEMNSQISVLKQTADELKTNIKEVPKRVAALQAELKDAQRENESLLAKLGNVEAGAILSKVKEVDGVNVLAAKVNAKDMNHLRTMVDELKAKLGSAVIVLGAVQNDKVNISAGVTKDLIEKGLHAGKLVKQAAEVCGGGGGGRPDMAQAGGKQPEKLEEALASVEDWVKSVL

SEQ ID NO: 28923 - protein, 319 aa, Bacillus subtilis
  strain 168
MKRIGVLTSGGDSPGMNAAVRAVVRKAIYHDVEVYGIYNGYAGLISGKIEKLELGSVGDIIHRGGTKLYTARCPEFKTVEGREKGIANLKKLGIEGLVVIGGDGSYMGAKKLTEHGFPCVGVPGTIDNDIPGTDFTIGFDTALNTVIDAIDKIRDTATSHERTYVIEVMGRHAGDIALWAGLAGGAESILIPEADYDMHEIIARLKRGHERGKKHSIIIVAEGVGSGVEFGKRIEEETNLETRVSVLGHIQRGGSPSAADRVLASRLGAYAVELLLEGKGGRCVGIQNNKLVDHDIIEILETKHTVEQNMYQLSKELSI

SEQ ID NO: 28924 - protein, 180 aa, Bacillus subtilis
  strain 168
MAERMVGKQAPRFEMEAVLASKEFGKVSLEENMKNDKWTVLFFYPMDFTFVCPTEITAMSDRYDEFEDLDAEVIGVSTDTIHTHLAWINTDRKENGLGQLKYPLAADTNHEVSREYGVLIEEEGVALRGLFIINPEGELQYQTVFHNNIGRDVDETLRVLQALQTGGLCPANWKPGQKTL

SEQ ID NO: 28925 - protein, 342 aa, Bacillus subtilis
  strain 168
MARVISMSDAINEAMKLAMRKDENVLLIGEDVAGGAAVDHLQDDEAWGGVLGVTKGLVQEFGRTRVLDTPISEAGYMGAAMAAASTGLRPIAELMFNDFIGTCFDQVINQGAKFRYMFGGKAQVPITVRTTYGAGFRAAAQHSQSLYGLFTSIPGLKTVVPSNPYDAKGLLLAAIEDNDPVFFFEDKTSYNMKGEVPEDYYTIPLGKADIKREGNDVTLFAVGKQVNTALEAAAQLSERGIEAEVLDPRSLSPLDEDAIFTSLEKTNRLIIIDEANPRCSIATDIAALVADKGFDLLDAPIKRITAPHTPVPFSPVLEDQYLPTPDKIVSVTLELLGEPALN

SEQ ID NO: 28926 - protein, 313 aa, Bacillus subtilis
  strain 168
MKTELIRTISLYDTIILHRHVRPDPDAYGSQCGLTEILRETYPEKNIFAVGTPEPSLSFLYSLDEVDNETYEGALVIVCDTANQERIDDQRYPSGAKLMKIDHHPNEDPYGDLLWVDTSASSVSEMIYELYLEGKEHGWKLNTKAAELIYAGIVGDTGRFLFPNTTEKTLKYAGELIQYPFSSSELFNQLYETKLNVVKLNGFIFQNVSLSENGAASVFIKKDTLEKFGTTASEASQLVGTLGNISGIRAWVFFVEEDDQIRVRFRSKGPVINGLARKYNGGGHPLASGASIYSWDEADRILADLETLCKEHE

SEQ ID NO: 28927 - protein, 365 aa, Bacillus subtilis
  strain 168
MKQEKERILKLVEEGKLTAQEALTLIEKLDSDYKEKEEKITALSVHVHDEEEPFTTAKKESGKPSLGAKLFDWIDSAVKKVKEVDLDLNFGHAYDVQHIFQFKDTDFSSVELQIANGSVNIVPWEDDDIRAECQAKVYRADSQDAARHAFLQHIECEIKGNKFFIRTEKKTMKTNVTLYIPQKEYDKIRVKLFNGPVRGEHLHVKEFSAKTTNGVLSFSYLTAEKAIAETANGQIKLASHSCGTIEAETINGLIDLRGKSESIDVQSFNGNIAINVTESDCRSIYAKTTTGNVELAIPDDLAVKAELKSNLGTLSHELMDVEMLKEKNDTIQKEMMFTSNQAHDQNITVFSESLTGAIKLKYSQR

SEQ ID NO: 28928 - protein, 495 aa, Bacillus subtilis
  strain 168
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 28929 - protein, 385 aa, Bacillus subtilis
  strain 168
MKKQNDIPQPIRGDKGATVKIPRNIERDRQNPDMLVPPETDHGTVSNMKFSFSDTHNRLEKGGYAREVTVRELPISENLASVNMRLKPGAIRELHWHKEAEWAYMIYGSARVTIVDEKGRSFIDDVGEGDLWYFPSGLPHSIQALEEGAEFLLVFDDGSFSENSTFQLTDWLAHTPKEVIAANFGVTKEEISNLPGKEKYIFENQLPGSLKDDIVEGPNGEVPYPFTYRLLEQEPIESEGGKVYIADSTNFKVSKTIASALVTVEPGAMRELHWHPNTHEWQYYISGKARMTVFASDGHARTFNYQAGDVGYVPFAMGHYVENIGDEPLVFLEIFKDDHYADVSLNQWLAMLPETFVQAHLDLGKDFTDVLSKEKHPVVKKKCSK

SEQ ID NO: 28930 - protein, 312 aa, Bacillus subtilis
  strain 168
MKAGILGVGRYIPEKVLTNHDLEKMVETSDEWIRTRTGIEERRIAADDVFSSHMAVAAAKNALEQAEVAAEDLDMILVATVTPDQSFPTVSCMIQEQLGAKKACAMDISAACAGFMYGVVTGKQFIESGTYKHVLVVGVEKLSSITDWEDRNTAVLFGDGAGAAVVGPVSDDRGILSFELGADGTGGQHLYLNEKRHTIMNGREVFKFAVRQMGESCVNVIEKAGLSKEDVDFLIPHQANIRIMEAARERLELPVEKMSKTVHKYGNTSAASIPISLVEELEAGKIKDGDVVVMVGFGGGLTWGAIAIRWGR

SEQ ID NO: 28931 - protein, 553 aa, Bacillus subtilis
  strain 168
MSIRTLDGRTFAEMILAGAQNLSQNASAVDALNVFPVPDGDTGTNMNLSMTSGAREVEQMDTDDIGKVGSALSKGLLMGARGNSGVILSQLFRGFSKNIETKKEINALEFAAALQAGVDMAYKAVMKPVEGTILTVAKDAAKKAMILAEKETDITALMTAVTEEAEASLNRTPELLPVLKEVGVVDSGGKGLLCVYEGFLASLKGETVPQKAVLPSLDDMVSAEHHKSAQSMMNTEDIEFGFCTEVMVRLDQTKREFDEGTFRQDLSQFGDSLLVIADESLAKVHIHAEEPGNVLNYAQHYGELIKIKIENMREQHTSIISQESKPADNETPPAKQPYGIVTVAMGEGIADLFKSIGASVVIEGGQTMNPSTEDIVDAVKSVNADTVFILPNNSNIIMAANQAASVVDEQVFVIPAKTVPQGMSALLAFNPDQEAEANEANMLSAIQQVKSGQVTFSVRDTHIDGKDIKKGDFMGILNGTIIGTSENQLSAAKMLLSEMIGEDDEIVTILYGEDASQEEAEQLEAFLSEKYEEIEVEIHNGKQPLYSYIVSAE

SEQ ID NO: 28932 - protein, 382 aa, Bacillus subtilis
  strain 168
MSLAPHGGTLVNRVDESYDVSGIQKEIELDLISFADLELIGIGAYSPIEGFFNEKDYVSVVENMRLSSGVVWSLPITLPVDAQKAAELSLGETVKLTYEGETYGVIQIEDLYVPDKQKEAVNVYKTDEQEHPGVKKLFSRGNTYVGGPITLIKKASKQFPEFTFEPSETRRQFAEKGWETIVGFQTRNPVHRAHEYIQKTALETVDGLFLNPLVGETKSDDIPADVRMESYQVLLDHYYPKDRVFLGVFLAAMRYAGPREAIFHALVRKNYGCTHFIVGRDHAGVGDYYGTYEAQELFDTFKPEELGITPLKFEHSFFCKKCGNMGTAKTCPHGREHHVILSGTKVRGMLRDGVLPPAEFSRKEVVEVLIKGMKKKEEVGVS

SEQ ID NO: 28933 - protein, 346 aa, Bacillus subtilis
  strain 168
MKAARWHNQKDIRIEHIEEPKTEPGKVKIKVKWCGICGSDLHEYLGGPIFIPVDKPHPLTNETAPVTMGHEFSGEVVEVGEGVENYKVGDRVVVEPIFATHGHQGAYNLDEQMGFLGLAGGGGGFSEYVSVDEELLFKLPDELSYEQGALVEPSAVALYAVRSSKLKAGDKAAVFGCGPIGLLVIEALKAAGATDIYAVELSPERQQKAEELGAIIVDPSKTDDVVAEIAERTGGGVDVAFEVTGVPVVLRQAIQSTTIAGETVIVSIWEKGAEIHPNDIVIKERTVKGIIGYRDIFPAVLSLMKEGYFSADKLVTKKIVLDDLIEEGFGALIKEKSQVKILVRPN

SEQ ID NO: 28934 - protein, 339 aa, Bacillus subtilis
  strain 168
MTASQQQIQLARRPQGIPVHEDFRFETIPVPEPKQGEVLVKTLYVSVDPYMRGRMQDTKSYVEPFALDKALSGGVIAEVVSDGNHLKKGDIVIGNLSWQEFSAVSESALRKIDTSLAPASAYLGILGMTGLTAYFGLLDIGRPKEGETVVVSGAAGAVGSTVGQIAKIKGARVVGIAGSDEKIDYLKQELQFDEAINYKTADDIQKALQNACPDGVDVYFDNVGGPISDAVMNLLNEFARIPVCGAISSYNAESEADDMGPRVQSKLIKTKSLMQGFIVSDYSDRFSEGAKQLAEWLKAGKLHYEETITEGFENIPDAFLGLFKGENKGKQLIKVSDPS

SEQ ID NO: 28935 - protein, 448 aa, Bacillus subtilis
  strain 168
MGKYFGTDGVRGVANSELTPELAFKVGRFGGYVLTKDKQRPKVLIGRDTRISGHMLEGALVAGLLSIGAEVMRLGVISTPGVSYLTKAMDAEAGVMISASHNPVQDNGIKFFGGDGFKLSDEQEAEIERLMDEPEDKLPRPVGADLGLVNDYFEGGQKYLQFLKQTADEDFTGIHVALDCANGATSSLATHLFADLDADVSTMGTSPNGLNINDGVGSTHPEALSAFVKEKNADLGLAFDGDGDRLIAVDEKGNIVDGDQIMYICSKHLKSEGRLKDDTVVSTVMSNLGFYKALEKEGIKSVQTAVGDRYVVEAMKKDGYNVGGEQSGHLIFLDYNTTGDGLLSAIMLMNTLKATGKPLSELAAEMQKFPQLLVNVRVTDKYKVEENEKVKAVISEVEKEMNGDGRILVRPSGTEPLVRVMAEAKTKELCDEYVNRIVEVVRSEMGLE

SEQ ID NO: 28936 - protein, 580 aa, Bacillus subtilis
  strain 168
MSERTFNWKNKDIRAQVDVVDSKLLPTLLLRNALVLNPYVKQWLKKNIWIYQDRIVYVGHELPNRAEEIHTIDCEGKYIVPGYIEPHAHPFQIYNPQTLAEYVSQYGTTTFVNDNLFLLLQSGKKKALTILNELKKQPVQYFWWSRYDLQTEVLNEDHVLPFDVRKQWIEHPDVIQGGEMTGWPRLVDGDDLMLHCMQATKKQRKRIEGHFPGASDKTLTKMKLFGADCDHEAMTGDEVMRRLELGYYVSLRNSSIRPDVRKILQELHEKGFRYYDHFFYTTDGATPNFYKGGMTNELIRIALEEGVPAIDAYNMASFNIAKYYQMDDYLGVVGPGRLASLNILEDPLNPNPVTVLSKGTILRENGCDLKAFTKTDWHKGGLVPLELSYDMTMDDLQFSMPMGVKMRNAVIMEPYMIEIDNSMEQLSFDHDESYLTMLDRHGKWRVNTMIKGFASSVQGFVSSFTTTGDIVAIGKNKADMLLAFARMKEIGGGIVLAENGNILHEIPLALCGCASSEAYEDVLEKEQKLRDLLTERGYEFCDPIYTLLFLQSTHLPYIRITPRGIFDVMKKTVLFPSIMR

SEQ ID NO: 28937 - protein, 357 aa, Bacillus subtilis
  strain 168
MNQETKALFQTLTQLPGAPGNEHQVRAFMKQELAKYADDIVQDRLGSVFGVRRGAEDAPRIMVAGHMDEVGFMVTSITDNGLLRFQTLGGWWSQVLLAQRVEIQTDNGPVPGVISSIPPHLLTDAQRNRPMDIKNMMIDIGADDKEDAIKIGIRPGQQIVPVCPFTTMANEKKILSKAWDNRYGCGLSIELLKELHGKELPNTLYAGATVQEEVGLRGAQTASHMIKPDLFFALDASPANDMSGDKNEFGQLGKGFLLRILDRTTVMHRGMREFVLDMAETHDIPYQYFVSGGGTDAGKVHISNSGVPSAVIGICSRYIHTNATIIHIDDYAAAKEMLIKLVTACDKQTVDAIKENM

SEQ ID NO: 28938 - protein, 233 aa, Bacillus subtilis
  strain 168
MSVHIGAEKGQIADTVLLPGDPLRAKFIAETYLENVECYNEVRGMYGFTGTYKGKKISVQGTGMGVPSISIYVNELIQSYDVQNLIRVGSCGAIRKDVKVRDVILAMTSSTDSQMNRVAFGSVDFAPCADFELLKNAYDAAKDKGVPVTVGSVFTADQFYNDDSQIEKLAKYGVLGVEMETTALYTLAAKHGRKALSILTVSDHVLTGEETTAEERQTTFHDMIEVALHSVSQ

SEQ ID NO: 28939 - protein, 463 aa, Bacillus subtilis
  strain 168
MNWEVEVIRKKEDLIRDTQEFLRINSVMDETTAGPGKPFGEGVNASLTSLLELGEKEGFTTKNLDGFAGHIEWGEGDDIIGVLCHVDVVPPGDGWTSDPFSAEIRNGRIYARGAIDDKGPTMAAFYALKIVKDMNLPLSKRVRMIIGTDEESDWRCVEHYFKHEEMPTMGFAPDADFPIINAEKGIIDASLLIPHRPNQAEPKAVLVSFQSGLRLNMVPDAAEAVIEGPKNEEILSSFKDMLRTTDQKGEAAIENGQLILRMYGLSCHAMEPNNGINAGILLCEFLQQTELDDAGKRFVQVVTDKFSGDTRGKKLDIDCEDEISGELTLNVGTLRYKEGQGGELGINIRYPVTAESKVIRDTFESASEFELGEFKDSKPHHVSADHPLVKTLQKVYEGQLGKKADLISIGGGTYARSLKAGVAFGPLFPGRPDSAHQKDEYIEIDDLLRSTALYAQAIYELAK

SEQ ID NO: 28940 - protein, 410 aa, Bacillus subtilis
  strain 168
MSLREEALHLHKVNQGKLESKSKVEVRNAKDLSLAYSPGVAEPCKDIHEDINKVYDYTMKGNMVAVVTDGTAVLGLGNIGPEAALPVMEGKAVLFKSFAGVDAFPIALNTNDVDKIVETVKLLEPTFGGVNLEDIAAPNCFIIEERLKKETNIPVFHDDQHGTAIVTVAGLVNALKLSGKSMSSIKVVANGAGAAGIAIIKLLHHYGVRDIVMCDSKGAIYEGRPNGMNDVKNEVAKFTNQDRKDGSLKDVIVDADVFIGVSVAGALTKEMVQSMAKDPIIFAMANPNPEIMPEDAREAGASVVGTGRSDFPNQVNNVLAFPGIFRGALDVRATHINEEMKIAAVEAIASLVSEDELSADYVIPAPFDKRVAPAVAKAVAKAAMETGVARITVDPEEVAEKTRKLTIIGE

SEQ ID NO: 28941 - protein, 123 aa, Bacillus subtilis
  strain 168
MALNIEEIIASVKEATVLELNDLVKAIEEEFGVTAAAPVAVAGGAAAGGAAEEQSEFDLILAGAGSQKIKVIKVVREITGLGLKEAKELVDNTPKPLKEGIAKEEAEELKAKLEEVGASVEVK

SEQ ID NO: 28942 - protein, 352 aa, Bacillus subtilis
  strain 168
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRIEGQKTAAFEVCEQLGEAPDVLAIPVGNAGNITAYWKGFKEYHEKNGTGLPKMRGFEAEGAAAIVRNEVIENPETIATAIRIGNPASWDKAVKAAEESNGKIDEVTDDEILHAYQLIARVEGVFAEPGSCASIAGVLKQVKSGEIPKGSKVVAVLTGNGLKDPNTAVDISEIKPVTLPTDEDSILEYVKGAARV

SEQ ID NO: 28943 - protein, 378 aa, Bacillus subtilis
  strain 168
MKFTIQKDRLVESVQDVLKAVSSRTTIPILTGIKIVASDDGVSFTGSDSDISIESFIPKEEGDKEIVTIEQPGSIVLQARFFSEIVKKLPMATVEIEVQNQYLTIIRSGKAEFNLNGLDADEYPHLPQIEEHHAIQIPTDLLKNLIRQTVFAVSTSETRPILTGVNWKVEQSELLCTATDSHRLALRKAKLDIPEDRSYNVVIPGKSLTELSKILDDNQELVDIVITETQVLFKAKNVLFFSRLLDGNYPDTTSLIPQDSKTEIIVNTKEFLQAIDRASLLAREGRNNVVKLSAKPAESIEISSNSPEIGKVVEAIVADQIEGEELNISFSPKYMLDALKVLEGAEIRVSFTGAMRPFLIRTPNDETIVQLILPVRTY

SEQ ID NO: 28944 - protein, 821 aa, Bacillus subtilis
  strain 168
MSEQNTPQVREINISQEMRTSFLDYAMSVIVSRALPDVRDGLKPVHRRILYAMNDLGMTSDKPYKKSARIVGEVIGKYHPHGDSAVYESMVRMAQDFNYRYMLVDGHGNFGSVDGDSAAAMRYTEARMSKISMEILRDITKDTIDYQDNYDGSEREPVVMPSRFPNLLVNGAAGIAVGMATNIPPHQLGEIIDGVLAVSENPDITIPELMEVIPGPDFPTAGQILGRSGIRKAYESGRGSITIRAKAEIEQTSSGKERIIVTELPYQVNKAKLIEKIADLVRDKKIEGITDLRDESDRTGMRIVIEIRRDANANVILNNLYKQTALQTSFGINLLALVDGQPKVLTLKQCLEHYLDHQKVVIRRRTAYELRKAEARAHILEGLRVALDHLDAVISLIRNSQTAEIARTGLIEQFSLTEKQAQAILDMRLQRLTGLEREKIEEEYQSLVKLIAELKDILANEYKVLEIIREELTEIKERFNDERRTEIVTSGLETIEDEDLIERENIVVTLTHNGYVKRLPASTYRSQKRGGKGVQGMGTNEDDFVEHLISTSTHDTILFFSNKGKVYRAKGYEIPEYGRTAKGIPIINLLEVEKGEWINAIIPVTEFNAELYLFFTTKHGVSKRTSLSQFANIRNNGLIALSLREDDELMGVRLTDGTKQIIIGTKNGLLIRFPETDVREMGRTAAGVKGITLTDDDVVVGMEILEEESHVLIVTEKGYGKRTPAEEYRTQSRGGKGLKTAKITENNGQLVAVKATKGEEDLMIITASGVLIRMDINDISITGRVTQGVRLIRMAEEEHVATVALVEKNEEDENEEEQEEV

SEQ ID NO: 28945 - protein, 462 aa, Bacillus subtilis
  strain 168
MEYRIERDTMGEVKVPADKFWGAQTQRSKENFKIGSEKMPMRVVKAFAILKRSTALANKRLGNLDAEKAEAIAAVCDDVLKGKYDDNFPLVVWQTGSGTQSNMNMNEVVANRATALLKEKNSDQTIHPNDDVNRSQSSNDTFPTAMHVAAVLAVYEQLVPALDQLRNTLDEKAKAYNDIVKIGRTHLQDATPLTLGQEISGWVHMLDRSKEMILEATDKMRALAIGGTAVGTGINAHPEFGELVSEEITKLTGQTFSSSPNKFHALTSHDEITYAHGALKALAADLMKIANDVRWLASGPRCGIGEIVIPENEPGSSIMPGKVNPTQSEALTMIAAQIMGNDATIGFAASQGNFELNVFKPVIIYNFLQSVQLLSDGMNSFHDKCAVGIEPNKETIQENLSNSLMLVTALNPHIGYENAAKIAKLAHKEGLTLKEAALKLELLTEEQFNEMVKPEDMVKPKA

SEQ ID NO: 28946 - protein, 586 aa, Bacillus subtilis
  strain 168
MSQSSIIVVGGGLAGLMATIKAAESGMAVKLFSIVPVKRSHSVCAQGGINGAVNTKGEGDSPWEHFDDTVYGGDFLANQPPVKAMCEAAPSIIHLLDRMGVMFNRTPEGLLDFRRFGGTQHHRTAYAGATTGQQLLYALDEQVRRYEVAGLVTKYEGWEFLGAVLDDDRTCRGIVAQNLTNMQIESFRSDAVIMATGGPGIIFGKSTNSMINTGSAASIVYQQGAYYANGEFIQIHPTAIPGDDKLRLMSESARGEGGRVWTYKDGKPWYFLEEKYPAYGNLVPRDIATREIFDVCVNQKLGINGENMVYLDLSHKDPKELDIKLGGIIEIYEKFMGDDPRKLPMKIFPAVHYSMGGLWVDYDQMTNIPGLFAAGECDYSMHGGNRLGANSLLSAIYGGMVAGPNAVKYVNGLESSAEDMSSSLFDAHVKKEEEKWADIMSMDGTENAYVLHKELGEWMTANVTVVRHNDKLLKTDDKIQELMERFKKININDTTKWSNQGAMFTRQFSNMLQLARVITLGAYNRNESRGAHYKPDYPERNDDEWLKTTMAKHVSPYEAPEFEYQDVDVSLITPRKRDYSKKKVAK

SEQ ID NO: 28947 - protein, 272 aa, Bacillus subtilis
  strain 168
MSMQEKIMRELHVKPSIDPKQEIEDRVNFLKQYVKKTGAKGFVLGISGGQDSTLAGRLAQLAVESIREEGGDAQFIAVRLPHGTQQDEDDAQLALKFIKPDKSWKFDIKSTVSAFSDQYQQETGDQLTDFNKGNVKARTRMIAQYAIGGQEGLLVLGTDHAAEAVTGFFTKYGDGGADLLPLTGLTKRQGRTLLKELGAPERLYLKEPTADLLDEKPQQSDETELGISYDEIDDYLEGKEVSAKVSEALEKRYSMTEHKRQVPASMFDDWWK

SEQ ID NO: 28948 - protein, 92 aa, Bacillus subtilis
  strain 168
MNKTELINAVAEASELSKKDATKAVDSVFDTILDALKNGDKIQLIGFGNFEVRERSARKGRNPQTGEEIEIPASKVPAFKPGKALKDAVAGK

SEQ ID NO: 28949 - protein, 570 aa, Bacillus subtilis
  strain 168
MQELKGIGASAGIAIAKAYRLEEPDLTVEKKNISDSEAEVSRFDEAIARSKEELEKIKEHALKELGQDKADIFSAHLLVLSDPELLNPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 28950 - protein, 88 aa, Bacillus subtilis
  strain 168
MAQKTFKVTADSGIHARPATVLVQTASKYDADVNLEYNGKTVNLKSIMGVMSLGIAKGAEITISASGADENDALNALEETMKSEGLGE

SEQ ID NO: 28951 - protein, 335 aa, Bacillus subtilis
  strain 168
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 28952 - protein, 909 aa, Bacillus subtilis
  strain 168
MANEQKTAAKDVFQARKTFTTNGKTYHYYSLKALEDSGIGKVSKLPYSIKVLLESVLRQVDGFVIKKEHVENLAKWGTAELKDIDVPFKPSRVILQDFTGVPAVVDLASLRKAMAAVGGDPDKINPEIPVDLVIDHSVQVDKAGTEDALAVNMDLEFERNAERYKFLSWAKKAFNNYQAVPPATGIVHQVNLEFLASVVHAIEEDGELVTYPDTLVGTDSHTTMINGIGVLGWGVGGIEAEAGMLGQPSYFPVPEVIGAKLVGKLPNGTTATDLALKVTQVLREKGVVGKFVEFFGPGIAELPLADRATIANMAPEYGATCGFFPVDEEALNYLRLTGRDPEHIDVVEAYCRSNGLFYTPDAEDPQFTDVVEIDLSQIEANLSGPKRPQDLIPLSAMQETFKKQLVSPAGNQGFGLNAEEENKEIKFKLLNGEETVMKTGAIAIAAITSCTNTSNPYVLIGAGLVAKKAVELGLKVPNYVKTSLAPGSKVVTGYLVNSGLLPYMKELGFNLVGYGCTTCIGNSGPLSPEIEEAVAKNDLLITSVLSGNRNFEGRIHPLVKGNYLASPPLVVAYALAGTVNINLKTDPIGVGKDGQNVYFNDIWPSMDEINALVKQTVTPELFRKEYETVFDDNKRWNEIETTDEALYKWDNDSTYIQNPPFFEEMSVEPGKVEPLKGLRVVGKFGDSVTTDHISPAGAIGKDTPAGKYLQEKGVSPRDFNSYGSRRGNHEVMMRGTFANIRIKNQIAPGTEGGFTTYWPTGEVTSIYDACMKYKEDKTGLVVLAGKDYGMGSSRDWAAKGTNLLGIRTVIAESFERIHRSNLVFMGVLPLQFKQGENADTLGLTGKEVIEVDVDETVRPRDLVTVRAINEDGNVTTFEAVVRFDSEVEIDYYRHGGILQMVLREKMKQS

SEQ ID NO: 28953 - protein, 600 aa, Bacillus subtilis
  strain 168
MCGIVGYIGQLDAKEILLKGLEKLEYRGYDSAGIAVANEQGIHVFKEKGRIADLREVVDANVEAKAGIGHTRWATHGEPSYLNAHPHQSALGRFTLVHNGVIENYVQLKQEYLQDVELKSDTDTEVVVQVIEQFVNGGLETEEAFRKTLTLLKGSYAIALFDNDNRETIFVAKNKSPLLVGLGDTFNVVASDAMAMLQVTNEYVELMDKEMVIVTDDQVVIKNLDGDVITRASYIAELDASDIEKGTYPHYMLKETDEQPVVMRKIIQTYQDENGKLSVPGDIAAAVAEADRIYIIGCGTSYHAGLVGKQYIEMWANVPVEVHVASEFSYNMPLLSKKPLFIFLSQSGETADSRAVLVQVKALGHKALTITNVPGSTLSREADYTLLLHAGPEIAVASTKAYTAQIAVLAVLASVAADKNGINIGFDLVKELGIAANAMEALCDQKDEMEMIAREYLTVSRNAFFIGRGLDYFVCVEGALKLKEISYIQAEGFAGGELKHGTIALIEQGTPVFALATQEHVNLSIRGNVKEVAARGANTCIISLKGLDDADDRFVLPEVNPALAPLVSVVPLQLIAYYAALHRGCDVDKPRNLAKSVTVE

SEQ ID NO: 28954 - protein, 389 aa, Bacillus subtilis
  strain 168
MSTKPFYRDTWAEIDLSAIKENVSNMKKHIGEHVHLMAVVKANAYGHGDAETAKAALDAGASCLAVAILDEAISLRKKGLKAPILVLGAVPPEYVAIAAEYDVTLTGYSVEWLQEAARHTKKGSLHFHLKVDTGMNRLGVKTEEEVQNVMAILDRNPRLKCKGVFTHFATADEKERGYFLMQFERFKELIAPLPLKNLMVHCANSAAGLRLKKGFFNAVRFGIGMYGLRPSADMSDEIPFQLRPAFTLHSTLSHVKLIRKGESVSYGAEYTAEKDTWIGTVPVGYADGWLRKLKGTDILVKGKRLKIAGRICMDQFMVELDQEYPPGTKVTLIGRQGDEYISMDEIAGRLETINYEVACTISSRVPRMFLENGSIMEVRNPLLQVNISN

SEQ ID NO: 28955 - protein, 154 aa, Bacillus subtilis
  strain 168
MNIIQGNLVGTGLKIGIVVGRFNDFITSKLLSGAEDALLRHGVDTNDIDVAWVPGAFEIPFAAKKMAETKKYDAIITLGTVIRGATTHYDYVCNEAAKGIAQAANTTGVPVIFGIVTTENIEQAIERAGTKAGNKGVDCAVSAIEMANLNRSFE

SEQ ID NO: 28956 - protein, 468 aa, Bacillus subtilis
  strain 168
MFNSIGVIGLGVMGSNIALNMANKGENVAVYNYTRDLTDQLIQKLDGQSLSPYYELEDFVQSLEKPRKIFLMVTAGKPVDSVIQSLKPLLEEGDVIMDGGNSHYEDTERRYDELKEKGIGYLGVGISGGEVGALTGPSIMPGGDRDVYEKAAPILTKIAAQVGDDPCCVYIGPKGAGHFTKMVHNGIEYADMQLIAEAYTFLRETLRLPLDEIASIFETWNQGELKSYLIEITAEILRKKDEKTGQPLIDVILDKTGQKGTGKWTSMQAIDNGIPSTIITESLFARYLSSLKEERMAAQDVLAGPEAEEKHLDKDTWIEYVRQALYMGKVCAYAQGFAQYKMSSELYGWNLPLKDIALIFRGGCIIRADFLNVISEAFSEQPNLANLLIAPYFTDKLHAYQTGLRKVVCEGISTGISFPCLTTALSYYDGYRTGRSNANLLQAQRDYFGAHTYERTDMDGVFHTNWSE

SEQ ID NO: 28957 - protein, 431 aa, Bacillus subtilis
  strain 168
MIERYSRPEMSAIWTDENRFQAWLEVEILACEAWAELGVIPKEDVKVMRENASFDINRILEIEKDTRHDVVAFTRAVSESLGEERKWVHYGLTSTDVVDTALSYLLKQANDILLKDLERFVDIIKEKAKEHKYTVMMGRTHGVHAEPTTFGLKLALWHEEMKRNLERFKQAKAGIEVGKISGAVGTYANIDPFVEQYVCEKLGLKAAPISTQTLQRDRHADYMATLALIATSIEKFAVEIRGLQKSETREVEEFFAKGQKGSSAMPHKRNPIGSENMTGMARVIRGYMMTAYENVPLWHERDISHSSAERIILPDATIALNYMLNRFSNIVKNLTVFPENMKRNMDRTLGLIYSQRVLLALIDTGLTREEAYDTVQPKAMEAWEKQVPFRELVEAEEKITSRLSPEKIADCFDYNYHLKNVDLIFERLGLA

SEQ ID NO: 28958 - protein, 512 aa, Bacillus subtilis
  strain 168
MTIKRALISVSDKTNLVPFVKELTELGVEVISTGGTKKLLQENGVDVIGISEVTGFPEIMDGRLKTLHPNIHGGLLAVRGNEEHMAQINEHGIQPIDLVVVNLYPFKETISKEDVTYEEAIENIDIGGPGMLRAASKNHQDVTVIVDPADYSPVLNQIKEEGSVSLQKKRELAAKVFRHTAAYDALIADYLTNVVGEKEPEQFTVTFEKKQSLRYGENPHQEATFYQTALPVKGSIAQAEQLHGKELSYNNIKDADAAVQIVREFTEPAAVAVKHMNPCGVGTGKTIAEAFDRAFEADKTSIFGGIIALNREVDKATAEALHNIFLEIIIAPSFSQEALDVLTAKKNLRLLTLDVSAAVQKEKQLTSVQGGLLIQDLDMHGFDDAEISIPTKREPNEQEWEDLKLAWKVVKHVKSNAIVLAKDNMTVGVGAGQMNRVGSAKIAIEQAGEKAKGSALGSDAYFPMPDTVEEAAKAGVTAIIQPGGSIRDEDSIKKADEYGIAMVFTGIRHFKH

SEQ ID NO: 28959 - protein, 444 aa, Bacillus subtilis
  strain 168
MAKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 28960 - protein, 132 aa, Bacillus subtilis
  strain 168
MIKSWKPQELSISYHQFTVFQKDSTPPVMDWTDEAIEKGYAAADGAISFEAQRNTKAFILFRLNSSETVNSYEKKVTVPFHVTENGIHIESIMSKRLSFDLPKGDYQLTCWTVPAEMSDLHADTYIIDAVSV

SEQ ID NO: 28961 - protein, 87 aa, Bacillus subtilis
  strain 168
MSERNQRKVYQGRVVSDKMDKTITVVVETYKKHTLYGKRVKYSKKFKAHDENNQAKIGDIVKIMETRPLSATKRFRLVEVVEEAVII

SEQ ID NO: 28962 - protein, 132 aa, Bacillus subtilis
  strain 168
MVMTDPIADMLTRIRNANMVRHEKLEIPASKLKREIAEILKREGFIRDVEFVEDSKQGIIRVFLKYGQNNERVITGLKRISKPGLRVYAKSNEVPRVLNGLGIAIISTSQGVLTDKEARAKQAGGEVLAYVW

SEQ ID NO: 28963 - protein, 535 aa, Bacillus subtilis
  strain 168
MTKYIFVTGGVVSSLGKGIVAASLGRLLKNRGLNVTIQKFDPYINVDPGTMSPYQHGEVFVTDDGAETDLDLGHYERFIDINLNKFSNVTTGKIYSTVLKKERRGDYLGGTVQVIPHITNELKDRVYRAGKETNADVVITEIGGTVGDIESLPFLEAIRQMKSDIGRENVMYIHCTLVPYIKAAGELKTKPTQHSVKELRSLGIQPNIIVVRTEMPISQDMKDKIALFCDIDTKAVIECEDADNLYSIPLELQKQGLDKLVCEHMKLACKEAEMSEWKELVNKVSNLSQTITIGLVGKYVELPDAYISVVESLRHAGYAFDTDVKVKWINAEEVTENNIAELTSGTDGIIVPGGFGDRGVEGKIVATKYARENNIPFLGICLGMQVASIEYARNVLGLKGAHSAEIDPSTQYPIIDLLPEQKDVEDLGGTLRLGLYPCKLEEGTKAFEVYQDEVVYERHRHRYEFNNEFRQQMEEQGFVFSGTSPDGRLVEIIELKDHPWFVASQFHPEFKSRPTRPQPLFKGFIGASVEAANQK

SEQ ID NO: 28964 - protein, 285 aa, Bacillus subtilis
  strain 168
MPLVSMTEMLNTAKEKGYAVGQFNLNNLEFTQAILQAAEEEKSPVILGVSEGAGRYMGGFKTVVAMVKALMEEYKVTVPVAIHLDHGSSFESCAKAIHAGFTSVMIDASHHPFEENVATTAKVVELAHFHGVSVEAELGTVGGQEDDVIAEGVIYADPKECQELVERTGIDCLAPALGSVHGPYKGEPNLGFKEMEEIGKSTGLPLVLHGGTGIPTADIKKSISLGTAKINVNTENQISSAKAVRETLAAKPDEYDPRKYLGPAREAIKETVIGKMREFGSSNQA

SEQ ID NO: 28965 - protein, 229 aa, Bacillus subtilis
  strain 168
MTKVNIVIIDDHQLFREGVKRILDFEPTFEVVAEGDDGDEAARIVEHYHPDVVIMDINMPNVNGVEATKQLVELYPESKVIILSIHDDENYVTHALKTGARGYLLKEMDADTLIEAVKVVAEGGSYLHPKVTHNLVNEFRRLATSGVSAHPQHEVYPEIRRPLHILTRRECEVLQMLADGKSNRGIGESLFISEKTVKNHVSNILQKMNVNDRTQAVVVAIKNGWVEMR

SEQ ID NO: 28966 - protein, 456 aa, Bacillus subtilis
  strain 168
MDKRFAVVLAAGQGTRMKSKLYKVLHPVCGKPMVEHVVDEALKLSLSKLVTIVGHGAEEVKKQLGDKSEYRVQAKQLGTAHAVKQAQPFLADEKGVTIVICGDTPLLTAETMEQMLKEHTQREAKRTILTAVAEDPTGYGRIIRSENGAVQKIVEHKDASEEERLVTEINTGTYCFDNEALFRAIDQVSNDNAQGEYYLPDVIEILKNEGETVAAYQTGNFQETLGVNDRVALSQAEQFMKERINKRHMQNGVTLIDPMNTYISPDAVIGSDTVIYPGTVIKGEVQIGEDTIIGPHTEIMNSAIGSRTVIKQSVVNHSKVGNDVNIGPFAHIRPDSVIGNEVKIGNFVEIKKTQFGDRSKASHLSYVGDAEVGTDVNLGCGSITVNYDGKNKYLTKIEDGAFIGCNSNLVAPVTVGEGAYVAAGSTVTEDVPGKALAIARARQVNKDDYVKNIHKK

SEQ ID NO: 28967 - protein, 317 aa, Bacillus subtilis
  strain 168
MSNQYGDKNLKIFSLNSNPELAKEIADIVGVQLGKCSVTRFSDGEVQINIEESIRGCDCYIIQSTSDPVNEHIMELLIMVDALKRASAKTINIVIPYYGYARQDRKARSREPITAKLFANLLETAGATRVIALDLHAPQIQGFFDIPIDHLMGVPILGEYFEGKNLEDIVIVSPDHGGVTRARKLADRLKAPIAIIDKRRPRPNVAEVMNIVGNIEGKTAILIDDIIDTAGTITLAANALVENGAKEVYACCTHPVLSGPAVERINNSTIKELVVTNSIKLPEEKKIERFKQLSVGPLLAEAIIRVHEQQSVSYLFS

SEQ ID NO: 28968 - protein, 104 aa, Bacillus subtilis
  strain 168
MAIVKATDQSFSAETSEGVVLADFWAPWCGPCKMIAPVLEELDQEMGDKLKIVKIDVDENQETAGKYGVMSIPTLLVLKDGEVVETSVGFKPKEALQELVNKHL

SEQ ID NO: 28969 - protein, 187 aa, Bacillus subtilis
  strain 168
MSEEKQTVEQNETEEQEIIEEQAAADEQQEETNESELLQNQINELQGLLEEKENKLLRVQADFENYKRRSRLEMEASQKYRSQNIVTDLLPALDSFERALQVEADNEQTKSLLQGMEMVHRQLVEALKKEGVEAIEAVGQEFDPNLHQAVMQAEDENYGSNIVVEEMQKGYKLKDRVIRPSMVKVNQ

SEQ ID NO: 28970 - protein, 417 aa, Bacillus subtilis
  strain 168
MAEIKVPELAESISEGTIAQWLKQPGDYVEQGEYLLELETDKVNVELTAEESGVLQEVLKDSGDTVQVGEIIGTISEGAGESSAPAPTEKTESKESVKEEKQAEPAAQEVSEEAQSEAKSRTIASPSARKLAREKGIDLSQVPTGDPLGRVRKQDVEAYEKPASKPAPQQKQQPQAQKAQQSFDKPVEVQKMSRRRQTIAKRLVEVQQTSAMLTTFNEVDMTAVMNLRKRRKDQFFEQNEVKLGFMSFFTKAVVAALKKYPLLNAEIQGDELIVKKFYDIGIAVAADEGLVVPVVRDADRLTFAGIEKEIGELAKKARNNKLTLSELQGGSFTITNGGTFGSLMSTPILNSPQVGILGMHKIQLRPVAIDEERFENRPMMYIALSYDHRIVDGKEAVGFLVTIKNLLEDPEQLLLEG

SEQ ID NO: 28971 - protein, 393 aa, Bacillus subtilis
  strain 168
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGASQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGFDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 28972 - protein, 314 aa, Bacillus subtilis
  strain 168
MMRTIKVGSRRSKLAMTQTKWVIQKLKEINPSFAFEIKEIVTKGDRIVDVTLSKVGGKGLFVKEIEQALLNEEIDMAVHSMKDMPAVLPEGLVIGCIPEREDPRDALISKNRVKLSEMKKGAVIGTSSLRRSAQLLIERPDLTIKWIRGNIDTRLQKLETEDYDAIILAAAGLSRMGWKQDVVTEFLEPERCLPAVGQGALAIECRESDEELLALFSQFTDEYTKRTVLAERAFLNAMEGGCQVPIAGYSVLNGQDEIEMTGLVASPDGKIIFKETVTGNDPEEVGKRCAALMADKGAKDLIDRVKRELDEDGK

SEQ ID NO: 28973 - protein, 348 aa, Bacillus subtilis
  strain 168
MSDRQAALDMALKQIEKQFGKGSIMKLGEKTDTRISTVPSGSLALDTALGIGGYPRGRIIEVYGPESSGKTTVALHAIAEVQQQGGQAAFIDAEHALDPVYAQKLGVNIEELLLSQPDTGEQALEIAEALVRSGAVDIVVVDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTKIKVVKNKVAPPFRTAEVDIMYGEGISKEGEIIDLGTELDIVQKSGSWYSYEEERLGQGRENAKQFLKENKDIMLMIQEQIREHYGLDNNGVVQQQAEETQEELEFEE

SEQ ID NO: 28974 - protein, 611 aa, Bacillus subtilis
  strain 168
MSKVIGIDLGTTNSCVAVLEGGEPKVIANAEGNRTTPSVVAFKNGERQVGEVAKRQSITNPNTIMSIKRHMGTDYKVEIEGKDYTPQEVSAIILQHLKSYAESYLGETVSKAVITVPAYFNDAERQATKDAGKIAGLEVERIINEPTAAALAYGLDKTDEDQTILVYDLGGGTFDVSILELGDGVFEVRSTAGDNRLGGDDFDQVIIDHLVSEFKKENGIDLSKDKMALQRLKDAAEKAKKDLSGVSSTQISLPFITAGEAGPLHLELTLTRAKFEELSSHLVERTMGPVRQALQDAGLSASEIDKVILVGGSTRIPAVQEAIKKETGKEAHKGVNPDEVVALGAAIQGGVITGDVKDVVLLDVTPLSLGIETMGGVFTKLIDRNTTIPTSKSQVFSTAADNQTAVDIHVLQGERPMSADNKTLGRFQLTDIPPAPRGVPQIEVSFDIDKNGIVNVRAKDLGTGKEQNITIKSSSGLSDEEIERMVKEAEENADADAKKKEEIEVRNEADQLVFQTEKTLKDLEGKVDEEQVKKANDAKDALKAAIEKNEFEEIKAKKDELQTIVQELSMKLYEEAAKAQQAQGGANAEGKADDNVVDAEYEEVNDDQNKK

SEQ ID NO: 28975 - protein, 382 aa, Bacillus subtilis
  strain 168
MLEFETNIDGLASIKVIGVGGGGNNAVNRMIENEVQGVEYIAVNTDAQALNLSKAEVKMQIGAKLTRGLGAGANPEVGKKAAEESKEQIEEALKGADMVFVTAGMGGGTGTGAAPVIAQIAKDLGALTVGVVTRPFTFEGRKRQLQAAGGISAMKEAVDTLIVIPNDRILEIVDKNTPMLEAFREADNVLRQGVQGISDLIATPGLINLDFADVKTIMSNKGSALMGIGIATGENRAAEAAKKAISSPLLEAAIDGAQGVLMNITGGTNLSLYEVQEAADIVASASDQDVNMIFGSVINENLKDEIVVTVIATGFIEQEKDVTKPQRPSLNQSIKTHNQSVPKREPKREEPQQQNTVSRHTSQPADDTLDIPTFLRNRNKRG

SEQ ID NO: 28976 - protein, 716 aa, Bacillus subtilis
  strain 168
MAKMRVYEYAKALNVSSKEILTALKNMDLEVNNHMAMLEEKAIKKLDAKYKKGGARAKSQKPAETNKNKQPQGVNQQSAGNQPNKIRDGKKNDVQNNQFNKNKKNNNNKKNKRNNNNNKNQHQQKPVKPKKELPEKITFSGTLTVGALAEELGKEPSELIKKLMLLGVMATINQELDKDTIELIASEYGVETEEVIVLEETELEKYEEPDNEEDLEIRPPVVTIMGHVDHGKTTLLDSIRKTKVVEGEAGGITQHIGAYQIEENGKKITFLDTPGHAAFTTMRARGAEVTDITILVVAADDGVMPQTVEAINHAKAAEVPIIVAVNKIDKESANPDRVMQELTEYGLVPEAWGGETIFVPLSALTGKGIDELVEMILLVSEVEELKANPNRQAKGTVIEAELDKGRGSVATLLVQTGTLHVGDPIVVGNTFGRVRAMVNDIGRRVKTAGPSTPVEITGLNDVPQAGDQFLVFKDEKTARSVGEARASKQLEEQRSDKAKLSLDDLFEQIKQGDVKDINLIVKADVQGSAEALTAALQKIEVEGVKVKIIHTGVGAITESDIILASASNAIVIGFNVRPDGNAKSTAEAENVDIRLHRIIYKVIDEIEAAMKGMLDPEYEEKVIGQVEVRQTFKVSKIGTIAGGYVTEGTITRDSGLRLIRDGVVIFEGEVDVLKRFKDDVKEVSQGYECGITIKKYNDIREGDILEAFVMQEIERT

SEQ ID NO: 28977 - protein, 344 aa, Bacillus subtilis
  strain 168
MEEKLKQLEQEALEQVEAASSLKVVNDIRVQYLGKKGPITEVLRGMGKLSAEERPKMGALANEVRERIANAIADKNEKLEEEEMKQKLAGQTIDVTLPGNPVAVGGRHPLTVVIEEIEDLFIGMGYTVEEGPEVETDYYNFESLNLPKEHPARDMQDSFYITEETLMRTQTSPVQTRTMEKHEGKGPVKIICPGKVYRRDNDDATHSHQFMQIEGLVVDKNISMSDLKGTLELVAKKMFGQDREIRLRPSFFPFTEPSVEVDVTCFKCGGNGCSVCKGTGWIEILGAGMVHPNVLKMAGFDPKEYQGFAFGMGVERIAMLKYGIDDIRHFYTNDVRFISQFKQA

SEQ ID NO: 28978 - protein, 804 aa, Bacillus subtilis
  strain 168
MFVSYKWLEDYVDLKGMDPAVLAEKITRAGIEVEGIEYKGEGIKGVVIGHVLEREQHPNADKLNKCLVDIGAEAPVQIICGAPNVDKGQKVAVATVGAVLPGNFKIKKAKLRGEESNGMICSLQELGIESKLVAKEYAEGIFVFPNDAETGSDALAALQLDDAILELGLTPNRADAMNMLGVAYEVAAILDTEVKLPQTDYPAASEQASDYISVKIEDQEANPLYTAKIIKNVTIAPSPLWMQTKLMNAGIRPHNNVVDITNFVLLEYGQPLHAFDYDRFGSKEVVVRKAAENEMIVTLDDQERKLSADHLVITNGTKAQAVAGVMGGAESEVQEDTKTILLEAAYFNGQKVRKASKDLGLRSESSVRFEKGIDPARVRLAAERAAQLIHLYAGGEVLAGTVEEDHLTIEANNIHVSADKVSSVLGLTISKEELISIYKRLGFTVGEADDLLVVTVPSRRGDITIEEDLIEEAARLYGYDNIPSTLPETAGTTGGLTPYQAKRRKVRRFLEGAGLSQAITYSLTNEKKATAFAIEKSLNTVLALPMSEERSILRHSLVPNLLDSVSYNLARQTDSVALYEVGSVFLTKEEDTKPVETERVAGAVTGLWRKQLWQGEKKPVDFFVVKGIVEGLLDKLNVLDSIEFVQSERKQLHPGRTANILLNGSLIGFIGQVHPSLEKELDIKETYVFELDLHALLAAETAPLVYTAIPKYPSVTRDIALVTDKTVTSGQLESVIKEAGGKLLKEVTVFDVYEGEHMEEGKKSVAFSLQYVNPEQTLTEEEVTKAHSKVLKALEDTYQAVLRG

SEQ ID NO: 28979 - protein, 581 aa, Bacillus subtilis
  strain 168
MTWRKSYERWKQTEHLDLELKERLIELEGDEQALEDCFYKDLEFGTGGMRGEIGAGTNRMNIYTVRKASAGFAAYISKQGEEAKKRGVVIAYDSRHKSPEFAMEAAKTLATQGIQTYVFDELRPTPELSFAVRQLNAYGGIVVTASHNPPEYNGYKVYGDDGGQLPPKEADIVIEQVNAIENELTITVDEENKLKEKGLIKIIGEDIDKVYTEKLTSISVHPELSEEVDVKVVFTPLHGTANKPVRRGLEALGYKNVTVVKEQELPDSNFSTVTSPNPEEHAAFEYAIKLGEEQNADILIATDPDADRLGIAVKNDQGKYTVLTGNQTGALLLHYLLSEKKKQGILPDNGVVLKTIVTSEIGRAVASSFGLDTIDTLTGFKFIGEKIKEYEASGQYTFQFGYEESYGYLIGDFARDKDAIQAALLAVEVCAFYKKQGMSLYEALINLFNEYGFYREGLKSLTLKGKQGAEQIEAILASFRQNPPQKMAGKQVVTAEDYAVSKRTLLTESKEEAIDLPKSNVLKYFLEDGSWFCLRPSGTEPKVKFYFAVKGSSLEDSEKRLAVLSEDVMKTVDEIVESTAK

SEQ ID NO: 28980 - protein, 319 aa, Bacillus subtilis
  strain 168
MHTVTQTSLYGKDLLTLKDLSEEDINALLAEAGELKQNKIQPIFHGKTLAMIFEKSSTRTRVSFEAGMAQLGGSALFLSQKDLQLGRGETVADTAKVLSGYVDAIMIRTFEHEKVEELAKEADIPVINGLTDKYHPCQALADLLTIKEIKGKLKGVKVAYIGDGNNVAHSLMIGCAKMGCDISIASPKGYEVLDEAAEAAKTYALQSGSSVTLTDDPIEAVKDADVIYSDVFTSMGQEAEEQERLAVFAPYQVNAALVSHAKPDYTFLHCLPAHREEEVTAEIIDGPNSAVFQQAENRLHVQKALLKAILYKGESSKNC

SEQ ID NO: 28981 - protein, 643 aa, Bacillus subtilis
  strain 168
MSDMVKITFPDGAVKEFAKGTTTEDIAASISPGLKKKSLAGKLNGKEIDLRTPINEDGTVEIITEGSEEGLQIMRHSAAHLLAQAIKRIYKDVKFGVGPVIENGFYYDVEMDEAITPEDLPKIEKEMKKIVNANLPIVRKEVSREEAKARFAEIGDDLKLELLDAIPEGETVSIYEQGEFFDLCRGVHVPSTGKIKEFKLLSLAGAYWRGDSKNQMLQRVYGTAFFKKADLEEHLRMLEEAKERDHRKLGKELKLFANSQKVGQGLPLWLPKGATIRRVIERYIVDKEISLGYEHVYTPVLGSKELYETSGHWDHYQEGMFPPMEMDNETLVLRPMNCPHHMMIYKQDIHSYRELPIRIAELGTMHRYEMSGALSGLQRVRGMTLNDAHIFVRPDQIKDEFIRTVRLIQDVYEDFGLSDYTFRLSYRDPEDTEKYFDDDEMWNKAQSMLKEAMDEIGHDYYEAEGEAAFYGPKLDVQVKTAIGKEETLSTVQLDFLLPERFDLTYIGEDGKQHRPVVIHRGVVSTMERFVAFLIEEHKGALPTWLAPVQFQVIPVSPAVHLDYAKKVQERLQCEGLRVEVDSRDEKIGYKIREAQMQKIPYMLVVGDQEAENGAVNVRKYGEQNSETISLDEFVKKAVAEAKK

SEQ ID NO: 28982 - protein, 212 aa, Bacillus subtilis
  strain 168
MLFFVDTANIDEIREANELGILAGVTTNPSLVAKEANVSFHDRLREITDVVKGSVSAEVISLKAEEMIEEGKELAKIAPNITVKIPMTSDGLKAVRALTDLGIKTNVTLIFNANQALLAARAGATYVSPFLGRLDDIGHNGLDLISEVKQIFDIHGLDTQIIAASIRHPQHVTEAALRGAHIGTMPLKVIHALTKHPLTDKGIEQFLADWNK

SEQ ID NO: 28983 - protein, 248 aa, Bacillus subtilis
  strain 168
MIICKTPRELGIMREAGRIVALTHEELKKHIKPGISTKELDQIAERFIKKQGAIPSFKGYNGFRGSICVSVNEELVHGIPGSRVLKDGDIISIDIGAKLNGYHGDSAWTYPVGNISDDDKKLLEVTEESLYKGLQEAKPGERLSNISHAIQTYVENEQFSVVREYVGHGVGQDLHEDPQIPHYGPPNKGPRLKPGMVLAIEPMVNAGSRYVKTLADNWTVVTVDGKKCAHFEHTIAITETGFDILTRV

SEQ ID NO: 28984 - protein, 120 aa, Bacillus subtilis
  strain 168
MSYRKLGRTSAQRKAMLRDLTTDLIINERIETTETRAKELRSVVEKMITLGKRGDLHARRQAAAYIRNEVANEENNQDALQKLFSDIATRYEERQGGYTRIMKLGPRRGDGAPMAIIELV

SEQ ID NO: 28985 - protein, 314 aa, Bacillus subtilis
  strain 168
MIEIEKPKIETVEISDDAKFGKFVVEPLERGYGTTLGNSLRRILLSSLPGAAVTSIQIDGVLHEFSTIEGVVEDVTTIILHIKKLALKIYSDEEKTLEIDVQGEGTVTAADITHDSDVEILNPDLHIATLGENASFRVRLTAQRGRGYTPADANKRDDQPIGVIPIDSIYTPVSRVSYQVENTRVGQVANYDKLTLDVWTDGSTGPKEAIALGSKILTEHLNIFVGLTDEAQHAEIMVEKEEDQKEKVLEMTIEELDLSVRSYNCLKRAGINTVQELANKTEEDMMKVRNLGRKSLEEVKAKLEELGLGLRKDD

SEQ ID NO: 28986 - protein, 428 aa, Bacillus subtilis
  strain 168
MFVDQVKVYVKGGDGGNGMVAFRREKYVPKGGPAGGDGGKGGDVVFEVDEGLRTLMDFRYKKHFKAIRGEHGMSKNQHGRNADDMVIKVPPGTVVTDDDTKQVIADLTEHGQRAVIARGGRGGRGNSRFATPANPAPQLSENGEPGKERYIVLELKVLADVGLVGFPSVGKSTLLSVVSSAKPKIADYHFTTLVPNLGMVETDDGRSFVMADLPGLIEGAHQGVGLGHQFLRHIERTRVIVHVIDMSGLEGRDPYDDYLTINQELSEYNLRLTERPQIIVANKMDMPEAAENLEAFKEKLTDDYPVFPISAVTREGLRELLFEVANQLENTPEFPLYDEEELTQNRVMYTMENEEVPFNITRDPDGVFVLSGDSLERLFKMTDFSRDESVKRFARQMRGMGVDEALRERGAKDGDIIRLLEFEFEFID

SEQ ID NO: 28987 - protein, 218 aa, Bacillus subtilis
  strain 168
MGQKVNPVGLRIGVIRDWESKWYAGKDYADFLHEDLKIREYISKRLSDASVSKVEIERAANRVNITIHTAKPGMVIGKGGSEVEALRKALNSLTGKRVHINILEIKRADLDAQLVADNIARQLENRVSFRRAQKQQIQRTMRAGAQGVKTMVSGRLGGADIARSEYYSEGTVPLHTLRADIDYATSEADTTYGKLGVKVWIYRGEVLPTKKKNEEGGK

SEQ ID NO: 28988 - protein, 95 aa, Bacillus subtilis
  strain 168
MRKYEVMYIIRPNIDEESKKAVIERFNNVLTSNGAEITGTKDWGKRRLAYEINDFRDGFYQIVNVQSDAAAVQEFDRLAKISDDIIRHIVVKEEE

SEQ ID NO: 28989 - protein, 488 aa, Bacillus subtilis
  strain 168
MWESKFSKEGLTFDDVLLVPAKSEVLPRDVDLSVELTKTLKLNIPVISAGMDTVTESAMAIAMARQGGLGIIHKNMSIEQQAEQVDKVKRSERGVITNPFFLTPDHQVFDAEHLMGKYRISGVPIVNNEEDQKLVGIITNRDLRFISDYSMKISDVMTKEELVTASVGTTLDEAEKILQKHKIEKLPLVDDQNKLKGLITIKDIEKVIEFPNSSKDIHGRLIVGAAVGVTGDTMTRVKKLVEANVDVIVIDTAHGHSQGVLNTVTKIRETYPELNIIAGNVATAEATRALIEAGADVVKVGIGPGSICTTRVVAGVGVPQITAIYDCATEARKHGKTIIADGGIKFSGDITKALAAGGHAVMLGSLLAGTSESPGETEIYQGRRFKVYRGMGSVAAMEKGSKDRYFQEENKKFVPEGIEGRTPYKGPVEETVYQLVGGLRSGMGYCGSKDLRALREEAQFIRMTGAGLRESHPHDVQITKESPNYTIS

SEQ ID NO: 28990 - protein, 470 aa, Bacillus subtilis
  strain 168
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 28991 - protein, 371 aa, Bacillus subtilis
  strain 168
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 28992 - protein, 325 aa, Bacillus subtilis
  strain 168
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 28993 - protein, 442 aa, Bacillus subtilis
  strain 168
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 28994 - protein, 483 aa, Bacillus subtilis
  strain 168
MGNEVRVRYAPSPTGHLHIGNARTALFNYLFARNQGGKFIIRVEDTDKKRNIEGGEQSQLNYLKWLGIDWDESVDVGGEYGPYRQSERNDIYKVYYEELLEKGLAYKCYCTEEELEKEREEQIARGEMPRYSGKHRDLTQEEQEKFIAEGRKPSIRFRVPEGKVIAFNDIVKGEISFESDGIGDFVIVKKDGTPTYNFAVAIDDYLMKMTHVLRGEDHISNTPKQIMIYQAFGWDIPQFGHMTLIVNESRKKLSKRDESIIQFIEQYKELGYLPEALFNFIGLLGWSPVGEEELFTKEQFIEIFDVNRLSKSPALFDMHKLKWVNNQYVKKLDLDQVVELTLPHLQKAGKVGTELSAEEQEWVRKLISLYHEQLSYGAEIVELTDLFFTDEIEYNQEAKAVLEEEQVPEVLSTFAAKLEELEEFTPDNIKASIKAVQKETGHKGKKLFMPIRVAVTGQTHGPELPQSIELIGKETAIQRLKNI

SEQ ID NO: 28995 - protein, 422 aa, Bacillus subtilis
  strain 168
MTNLLEDLSFRGLIQQMTDEEGLNKQLNEEKIRLYSGFDPTADSLHIGHLLPILTLRRFQLAGHHPIALVGGATGLIGDPSGKKAERTLNTADIVSEWSQKIKNQLSRFLDFEAAENPAVIANNFDWIGKMNVIDFLRDVGKNFGINYMLAKDTVSSRIESGISYTEFSYMILQSYDFLNLYRDKNCKLQIGGSDQWGNITAGLELIRKSEEEGAKAFGLTIPLVTKADGTKFGKTEGGAIWLDKEKTSPYEFYQFWINTDDRDVVKYLKYFTFLSKEEIEAYAEKTETAPEKREAQKRLAEEVTSLVHGREALEQAINISQALFSGNIKELSAQDVKVGFKDVPSMEVDSTQELSLVDVLVQSKLSPSKRQAREDIQNGAVYINGERQTEINYTLSGEDRIENQFTVLRRGKKKYFLVTYK

SEQ ID NO: 28996 - protein, 944 aa, Bacillus subtilis
  strain 168
MFQNSMKQRMNWEDFYGPNLGYALELYDQYTQDPNSIDPDLKEMFDELGAPPSDIKEASGTKEKGRVTADLIQKIASAVRLAEDIRTYGHLNASVNPLRKDEKKSELFPLSDYGLTEEEIKAIPASVICKDAPKNISNGLEAIQYLRNTYKRTISFEFDHVHDFKEREWLTRKIESGELFQKNSAEKLSAVLERLTEVEGFEQFLHRTFVGQKRFSIEGLDALVPVLDDIIAQSVKSGTTSVNIGMAHRGRLNVLAHVLGKPYEIIFSEFQHAPNKDLVPSEGSIGISYGWTGDVKYHLGANRELQDAETKSARITLANNPSHLEFINPIVEGSTRAAQETRTQSGYPVQDETKSLAILIHGDAAFPGEGIVAETLNLSSLKGYQVGGAIHIIANNMIGFTTESAESRSTKYASDLAKGYEIPIVHVNADDPEACLSAVKFAVEYRKTFNKDFLIDLIGYRRYGHNEMDEPSTTQPMLYDAVRKHPTVKQIFAEKLVKEGVVTEEVVQNIEKSVTKRIEDAYQKVPSKKEHTACEIELPEPVSNGFPDVDTSIDFDVLRKLNGELINWPESFNVFGKLKRILERRAKAFDDDRKVEWSLAESLAFASILKDGTPIRLTGQDSERGTFAQRNLVLHDSETGKEFVPLHHLSDCSTSFAVHNSPLSEGSVLGFEYGYNVHSPETLVLWEAQYGDFANAAQVYFDQFISAGRAKWGQKSGLVMLLPHGYEGQGPEHSSGRIERFLQLAAENNWTVANLTSAAQYFHILRRQAKMLLREEIRPLVIMTPKSLLRNPNTVSEVQELSESRFQPVYEQSGLSHDYEKVTRLVLSSGKVSIDISDHFNKLEDGKEWLHIARIEQLYPFPAKGVKELFAKLPNLKEIVWVQEEPQNMGAWGYISPYLTEIAPEGVSVQYIGRRRRSSPAEGDPTVHKKEQERIVSDSLTRKN

SEQ ID NO: 28997 - protein, 264 aa, Bacillus subtilis
  strain 168
MLRSLYSGISGMKNFQTKLDVIGNNIANVNTVGFKKSRVTFKDMVSQTIAGGSAAGATIGGTNSKQIGLGSSSGTIDTIHSTSATQSTGRTLDLAIDGDGYFRIDTGDGTAYTRAGNFYLDNTGTLVTGDGYHVLNMNGGTIKIPTDAQSFSIGSDGKVSIVDAEGKTQDGGQIGIVTFANSDGLDKIGSNLYRESLNSGTASAANQPGDGGTGALKSGFLEMSNVDLTDEFTEMIVAQRGFQSNSKIITTSDEILQELVNLKR

SEQ ID NO: 28998 - protein, 271 aa, Bacillus subtilis
  strain 168
MAEWKTKRTYDEILYETYNGIAKITINRPEVHNAFTPKTVAEMIDAFADARDDQNVGVIVLAGAGDKAFCSGGDQKVRGHGGYVGDDQIPRLNVLDLQRLIRVIPKPVVAMVSGYAIGGGHVLHIVCDLTIAADNAIFGQTGPKVGSFDAGYGSGYLARIVGHKKAREIWYLCRQYNAQEALDMGLVNTVVPLEQLEEETIKWCEEMLEKSPTALRFLKAAFNADTDGLAGIQQFAGDATLLYYTTDEAKEGRDSFKEKRKPDFGQFPRFP

SEQ ID NO: 28999 - protein, 358 aa, Bacillus subtilis
  strain 168
MIRVTRLLEVKDLAISFKTYGGEVQAIRGVNFHLDKGETLAIVGESGSGKSVTSQAIMKLIPMPPGYFKRGEILFEGKDLVPLSEKEMQNVRGKEIGMIFQDPMTSLNPTMKVGKQITEVLFKHEKISKEAAKKRAVELLELVGIPMPEKRVNQFPHEFSGGMRQRVVIAMALAANPKLLIADEPTTALDVTIQAQILELMKDLQKKIDTSIIFITHDLGVVANVADRVAVMYAGQIVETGTVDEIFYDPRHPYTWGLLASMPTLESSGEEELTAIPGTPPDLTNPPKGDAFALRSSYAMKIDFEQEPPMFKVSDTHYVKSWLLHPDAPKVEPPEAVKAKMRKLANTFEKPVLVREVE

SEQ ID NO: 29000 - protein, 628 aa, Bacillus subtilis
  strain 168
MGYEAGQYDVIVIGAGHAGVEAALASARQGAKTLVLTINLDMVAFMPCNPSVGGPAKGIVVREIDALGGEMGRNIDKTHIQMRMLNTGKGPAVRALRAQADKFQYQHEMKNTLEKEPNLTLLQGIVERLIVEDGECRGVITQTGAHYRAKAVVMTTGTYLRGRIILGDLSYSSGPNNQQPSIKLSEHLEELGFDLVRFKTGTPPRVKSDTIDYSKTEIQPGDDVPRAFSYETVEYITDQLPCWLTYTSPETHEIIDSNLHRSPMYSGMIKGTGPRYCPSIEDKVVRFNDKPRHQIFLEPEGRNTQEVYVQGLSTSLPEDVQQRMLATIPGLENVQMMRAGYAIEYDAIVPTQLWPTLETKKITNLYTAGQINGTSGYEEAAGQGIMAGINAGRKALGKEEVILSRSDAYIGVLIDDLVTKGTNEPYRLLTSRAEYRLLLRHDNADLRLTEIGHRIGLISDERYAAFEKKKAAIEAEKKRLHSVIIKPSPENQEYIRSLGGSELKDGVRGTDLMKRPEMNYETVTKLAPPEVPVPQDVAEQVEIQVKYEGYIEKSLQQVEKLKKMENKKIPDRIDYDAIKGIATEARQKLKNVRPLSVAQASRISGVNPADISILLVYLEQGRIAKIAE

SEQ ID NO: 29001 - protein, 428 aa, Bacillus subtilis
  strain 168
MSYLIKNGWILNENGEKTQADIRVTGETITAIGKLDATDNETVIDAKGLLVSPGFVDLHVHFREPGGEKKETIETGAKAAARGGYTTVAAMPNTRPVPDTKEQMEWVQNRIKETSCVRVLPYASITIRQIGDEMTNFEALKEAGAFAFTDDGVGIQTAGMMYEAMKRAAAIDKAIVAHCEDNSLIYGGSVHEGTFSKANGLNGIPSVCESVHIARDVLLAEAANCHYHVCHISTKESVRVVRDAKKAGIRVTAEVSPHHLLLCDEDIPGLDTNYKMNPPLRSPEDRAALIEGLLDGTIDFIATDHAPHTEEEKNTEMKLAPFGIVGLETAFPLLYTHFVKNGSWSLKQLIDYMTIKPCEAFGLPYGTLQTGQAADITLIDLEKEAVIDKETFLSKGKNTPFNGISCTGWPVATIAAGKLAYEEGRLVK

SEQ ID NO: 29002 - protein, 475 aa, Bacillus subtilis
  strain 168
MLNGQKEYRVEKDFLGEKQIEADVYYGIQTLRASENFPITGYKIHEEMINALAIVKKAAALANMDVKRLYEGIGQAIVQAADEILEGKWHDQFIVDPIQGGAGTSMNMNANEVIGNRALEIMGHKKGDYIHLSPNTHVNMSQSTNDVFPTAIHISTLKLLEKLLKTMEDMHSVFKQKAQEFDSVIKMGRTHLQDAVPIRLGQEFEAYSRVLERDIKRIKQSRQHLYEVNMGATAVGTGLNADPEYIKQVVKHLADISGLPLVGADHLVDATQNTDAYTEVSASLKVCMMNMSKIANDLRLMASGPRAGLAEISLPARQPGSSIMPGKVNPVMAELINQIAFQVIGNDNTICLASEAGQLELNVMEPVLVFNLLQSISIMNNGFRSFTDNCLKGIEANEKRMKQYVEKSAGVITAVNPHLGYEAAARIAREAIMTGQSVRDLCLQHDVLTEEELDIILNPYEMTKPGIAGKELLEK

SEQ ID NO: 29003 - protein, 483 aa, Bacillus subtilis
  strain 168
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 29004 - protein, 102 aa, Bacillus subtilis
  strain 168
MYAIIKTGGKQIKVEEGQTVYIEKLAAEAGETVTFEDVLFVGGDNVKVGNPTVEGATVTAKVEKQGRAKKITVFRYKPKKNVHKKQGHRQPYTKVTIEKINA

SEQ ID NO: 29005 - protein, 3587 aa, Bacillus subtilis
  strain 168
MEITFYPLTDAQKRIWYTEKFYPHTSISNLAGIGKLVSADAIDYVLVEQAIQEFIRRNDAMRLRLRLDENGEPVQYISEYRPVDIKHTDTTEDPNAIEFISQWSREETKKPLPLYDCDLFRFSLFTIKENEVWFYANVHHVISDGISMNILGNAIMHIYLELASGSETKEGISHSFIDHVLSEQEYAQSKRFEKDKAFWNKQFESVPELVSLKRNASAGGSLDAERFSKDVPEALHQQILSFCEANKVSVLSVFQSLLAAYLYRVSGQNDVVTGTFMGNRTNAKEKQMLGMFVSTVPLRTNIDGGQAFSEFVKDRMKDLMKTLRHQKYPYNLLINDLRETKSSLTKLFTVSLEYQVMQWQKEEDLAFLTEPIFSGSGLNDVSIHVKDRWDTGKLTIDFDYRTDLFSREEINMICERMITMLENALTHPEHTIDELTLISDAEKEKLLARAGGKSVSYRKDMTIPELFQEKAELLSDHPAVVFEDRTLSYRTLHEQSARIANVLKQKGVGPDSPVAVLIERSERMITAIMGILKAGGAYVPIDPGFPAERIQYILEDCGADFILTESKVAAPEADAELIDLDQAIEEGAEESLNADVNARNLAYIIYTSGTTGRPKGVMIEHRQVHHLVESLQQTIYQSGSQTLRMALLAPFHFDASVKQIFASLLLGQTLYIVPKKTVTNGAALTAYYRKNSIEATDGTPAHLQMLAAAGDFEGLKLKHMLIGGEGLSSVVADKLLKLFKEAGTAPRLTNVYGPTETCVDASVHPVIPENAVQSAYVPIGKALGNNRLYILDQKGRLQPEGVAGELYIAGDGVGRGYLHLPELTEEKFLQDPFVPGDRMYRTGDVVRWLPDGTIEYLGREDDQVKVRGYRIELGEIEAVIQQAPDVAKAVVLARPDEQGNLEVCAYVVQKPGSEFAPAGLREHAARQLPDYMVPAYFTEVTEIPLTPSGKVDRRKLFALEVKAVSGTAYTAPRNETEKAIAAIWQDVLNVEKAGIFDNFFETGGHSLKAMTLLTKIHKETGIEIPLQFLFEHPTITALAEEADHRESKAFAVIEPAEKQEHYPLSLAQQRTYIVSQFEDAGVGYNMPAAAILEGPLDIQKLERAFQGLIRRHESLRTSFVLENSTPRQKIHDSVDFNIEMIERGGRSDEAIMASFVRTFDLAKAPLFRIGLLGLEENRHMLLFDMHHLISDGVSIGIMLEELARIYKGEQLPDLRLQYKDYAVWQSRQAAEGYKKDQAYWKEVFAGELPVLQLLSDYPRPPVQSFEGDRVSIKLDAGVKDRLNRLAEQNGATLYMVMLSAYYTLLSKYTGQDDIIVGTPSAGRNHSDTEGIIGMFVNTLAIRSEVKQNETFTQLISRVRKRVLDAFSHQDYPFEWLVEDLNIPRDVSRHPLFDTMFSLQNATEGIPAVGDLSLSVQETNFKIAKFDLTVQARETDEGIEIDVDYSTKLFKQSTADRLLTHFARLLEDAAADPEKPISEYKLLSEEEAASQIQQFNPGRTPYPKDKTIVQLFEEQAANTPDHTALQYEGESLTYRELNERANRLARGILSLGAGEGRTAAVLCERSMDMIVSILAVLKSGSAYVPIDPEHPIQRMQHFFRDSGAKVLLTQRKLKALAEEAEFKGVIVLADEEESYHADARNLALPLDSAAMANLTYTSGTTGTPKGNIVTHANILRTVKETNYLSITEQDTILGLSNYVFDAFMFDMFGSLLNGAKLVLIPKETVLDMARLSRVIERENISILMITTALFHLLVDLNPACLSTLRKIMFGGERASVEHVRKALQTVGKGKLLHMYGPSESTVFATYHPVDELEEHTLSVPIGKPVSNTEVYILDRTGHVQPAGIAGELCVSGEGLVKGYYNRPELTEEKFVPHPFTSGERMYKTGDLARWLPNGDIEFIGRIDHQVKIRGQRIELGEIEHQLQTHDRVQESVVLAVDQGAGDKLLCAYYVGEGDISSQEMREHAAKDLPAYMVPAVFIQMDELPLTGNGKIDRRALPIPDANVSRGVSYVAPRNGTEQKVADIWAQVLQAEQVGAYDHFFDIGGHSLAGMKMLALVHQELGVELSLKDLFQSPTVEGLAQVIASAEKGTAASISPAEKQDTYPVSSPQKRMYVLQQLEDAQTSYNMPAVLRLTGELDVERLNSVMQQLMQRHEALRTTFEIKDGETVQRIWEEAECEIAYFEAPEEETERIVSEFIKPFKIDQLPLFRIGLIKHSDTEHVLLFDMHHIISDGASVGVLIEELSKLYDGETLEPLRIQYKDYAVWQQQFIQSELYKKQEEHWLKELDGELPVLTLPTDYSRPAVQTFEGDRIAFSLEAGKADALRRLAKETDSTLYMVLLASYSAFLSKISGQDDIIVGSPVAGRSQADVSRVIGMFVNTLALRTYPKGEKTFADYLNEVKETALSAFDAQDYPLEDLIGNVQVQRDTSRNPLFDAVFSMQNANIKDLTMKGIQLEPHPFERKTAKFDLTLTADETDGGLTFVLEYNTALFKQETIERWKQYWMELLDAVTGNPNQPLSSLSLVTETEKQALLEAWKGKALPVPTDKTVHQLFEETAQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEENPETAVTAENLAYMIYTSGTTGQPKGVMVEHHALVNLCFWHHDAFSMTAEDRSAKYAGFGFDASIWEMFPTWTIGAELHVIEEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWTGGGIEYIGRIDQQVKVRGYRIELSEIEVQLAQLSEVQDAAVTAVKDKGGNTAIAAYVTPESADIEALKSALKETLPDYMIPAFWVTLNELPVTANGKVDRKALPEPDIEAGSGEYKAPTTDMEELLAGIWQDVLGMSEVGVTDNFFSLGGDSIKGIQMASRLNQHGWKLEMKDLFQHPTIEELTQYVERAEGKQADQGPVEGEVILTPIQRWFFEKNFTNKHHWNQSVMLHAKKGFDPERVEKTLQALIEHHDALRMVYREGQEDVIQYNRGLEAASAQLEVIQIEGQAADYEDRIEREAERLQSSIDLQEGGLLKAGLFQAEDGDHLLLAIHHLVVDGVSWRILLEDFAAVYTQLEQGNEPVLPQKTHSFAEYAERLQDFANSKAFLKEKEYWRQLEEQAVAAKLPKDRESGDQRMKHTKTIEFSLTAEETEQLTTKVHEAYHTEMNDILLTAFGLAMKEWTGQDRVSVHLEGHGREEIIEDLTISRTVGWFTSMYPMVLDMKHADDLGYQLKQMKEDIRHVPNKGVGYGILRYLTAPEHKEDVAFSIQPDVSFNYLGQFDEMSDAGLFTRSELPSGQSLSPETEKPNALDVVGYIENGKLTMSLAYHSLEFHEKTVQTFSDSFKAHLLRIIEHCLSQDGTELTPSDLGDDDLTLDELDKLMEIF

SEQ ID NO: 29006 - protein, 253 aa, Bacillus subtilis
  strain 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 29007 - protein, 366 aa, Bacillus subtilis
  strain 168
MELSEIRAELENMASRLADFRGSLDLESKEARIAELDEQMADPEFWNDQQKAQTVINEANGLKDYVNSYKKLNESHEELQMTHDLLKEEPDTDLQLELEKELKSLTKEFNEFELQLLLSEPYDKNNAILELHPGAGGTESQDWGSMLLRMYTRWGERRGFKVETLDYLPGDEAGIKSVTLLIKGHNAYGYLKAEKGVHRLVRISPFDSSGRRHTSFVSCEVMPEFNDEIDIDIRTEDIKVDTYRASGAGGQHVNTTDSAVRITHLPTNVVVTCQTERSQIKNRERAMKMLKAKLYQRRIEEQQAELDEIRGEQKEIGWGSQIRSYVFHPYSMVKDHRTNTEMGNVQAVMDGDIDTFIDAYLRSKLS

SEQ ID NO: 29008 - protein, 189 aa, Bacillus subtilis
  strain 168
MNYNIRGENIEVTPALKDHVERKIGKLERYFDHSVDADVNVNLKFYNDKESKVEVTIPMTDLALRSEVHNEDMYNAIDLATNKLERQIRKHKTKVNRKFREQGSPKYLLANGLGSDTDIAVQDDIEEEESLDIVRQKRFNLKPMDSEEAILQMNMLGHNFFVFTNAETNLTNVVYRRNDGKYGLIEPTE

SEQ ID NO: 29009 - protein, 544 aa, Bacillus subtilis
  strain 168
MAKEIKFSEEARRAMLRGVDALADAVKVTLGPKGRNVVLEKKFGSPLITNDGVTIAKEIELEDAFENMGAKLVAEVASKTNDVAGDGTTTATVLAQAMIREGLKNVTAGANPVGVRKGMEQAVAVAIENLKEISKPIEGKESIAQVAAISAADEEVGSLIAEAMERVGNDGVITIEESKGFTTELEVVEGMQFDRGYASPYMVTDSDKMEAVLDNPYILITDKKITNIQEILPVLEQVVQQGKPLLLIAEDVEGEALATLVVNKLRGTFNAVAVKAPGFGDRRKAMLEDIAVLTGGEVITEDLGLDLKSTQIAQLGRASKVVVTKENTTIVEGAGETDKISARVTQIRAQVEETTSEFDREKLQERLAKLAGGVAVIKVGAATETELKERKLRIEDALNSTRAAVEEGIVSGGGTALVNVYNKVAAVEAEGDAQTGINIVLRALEEPIRQIAHNAGLEGSVIVERLKNEEIGVGFNAATGEWVNMIEKGIVDPTKVTRSALQNAASVAAMFLTTEAVVADKPEENGGGAGMPDMGGMGGMGGMM

SEQ ID NO: 29010 - protein, 94 aa, Bacillus subtilis
  strain 168
MLKPLGDRVVIELVESEEKTASGIVLPDSAKEKPQEGKIVAAGSGRVLESGERVALEVKEGDRIIFSKYAGTEVKYEGTEYLILRESDILAVIG

SEQ ID NO: 29011 - protein, 261 aa, Bacillus subtilis
  strain 168
MARKKKKKHEDEHVDESWLVPYADILTLLLALFIVLYASSSIDAAKFQMLSKSFNEVFTGGTGVLDYSSVTPPENESDGIDEVKKEKEEKEKNKKEKEKAADQEELENVKSQVEKFIKDKKLEHQLETKMTSEGLLITIKDSIFFDSGKATIRKEDVPLAKEISNLLVINPPRNIIISGHTDNMPIKNSEFQSNWHLSVMRAVNFMGLLIENPKLDAKVFSAKGYGEYKPVASNKTAEGRSKNRRVEVLILPRGAAETNEK

SEQ ID NO: 29012 - protein, 120 aa, Bacillus subtilis
  strain 168
MDKVYVEGMEFYGYHGVFTEENKLGQRFKVDLTAELDLSKAGQTDDLEQTINYAELYHVCKDIVEGEPVKLVETLAERIAGTVLGKFQPVQQCTVKVIKPDPPIPGHYKSVAIEITRKKS

SEQ ID NO: 29013 - protein, 513 aa, Bacillus subtilis
  strain 168
MTKLVNEMILVLDFGSQYNQLITRRIREFGVYSELHPHTLTAEEIKKMNPKGIILSGGPNSVYDENSFRCDEKIFELDIPVLGICYGMQLMTHYLGGKVEAASQREYGKANIRIEGTPDLFRDLPNEQVVWMSHGDLVVEVPEGFTVDATSHHCPNSAMSKADKKWYGVQFHPEVRHSEYGNDLLKNFVFGVCECEGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEADKLKGIDYLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIANHGLERDIWQYFTVLPDIRSVGVMGDARTYDYTIGIRAVTSIDGMTSDWARIPWDVLEVISTRIVNEVKHINRVVYDITSKPPATIEWE

SEQ ID NO: 29014 - protein, 430 aa, Bacillus subtilis
  strain 168
MRSYEKSKTAFKEAQKLMPGGVNSPVRAFKSVDMDPIFMERGKGSKIFDIDGNEYIDYVLSWGPLILGHTNDRVVESLKKVAEYGTSFGAPTEVENELAKLVIDRVPSVEIVRMVSSGTEATMSALRLARGYTGRNKILKFEGCYHGHGDSLLIKAGSGVATLGLPDSPGVPEGIAKNTITVPYNDLESVKLAFQQFGEDIAGVIVEPVAGNMGVVPPQEGFLQGLRDITEQYGSLLIFDEVMTGFRVDYNCAQGYFGVTPDLTCLGKVIGGGLPVGAYGGKAEIMEQIAPSGPIYQAGTLSGNPLAMTAGLETLKQLTPESYKNFIKKGDRLEEGISKTAGAHGIPHTFNRAGSMIGFFFTNEPVINYETAKSSDLKLFASYYKGMANEGVFLPPSQFEGLFLSTAHTDEDIENTIQAAEKVFAEISRR

SEQ ID NO: 29015 - protein, 324 aa, Bacillus subtilis
  strain 168
MSQSFNRHRRLRTSKAMREMVKETRLHPSDFIYPIFVVEGLEGKKAVPSMPDVHHVSLDLLKDEVAELVKLGIQSVIVFGIPEEKDDCGTQAYHDHGIVQKAITEIKEHFPEMVVVADTCLCEYTDHGHCGLVKDGVILNDESLELLAQTAVSQAKAGADIIAPSNMMDGFVTVIREALDKEGFVNIPIMSYAVKYSSEFYGPFRDAANSTPQFGDRKTYQMDPANRMEALREAQSDVEEGADFLIVKPSLSYMDIMRDVKNEFTLPLVAYNVSGEYSMVKAAAQNGWIKEKEIVLEILTSMKRAGADLIITYHAKDAAKWLAE

SEQ ID NO: 29016 - protein, 149 aa, Bacillus subtilis
  strain 168
MMEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 29017 - protein, 189 aa, Bacillus subtilis
  strain 168
MERISWNQYFMAQSHLLALRSTCPRLSVGATIVRDKRMIAGGYNGSIAGGVHCADEGCLMIDDHCARTIHAEMNAILQCSKFGVPTDGAEIYVTHYPCIQCCKSIIQAGIKTVYYAEDYKTHPYAQELFEQAGVTVEQVELDEMIVDLKNREKLSFVAGLIGKLADAGLAEEELKKIHEQANTLFTSYV

SEQ ID NO: 29018 - protein, 310 aa, Bacillus subtilis
  strain 168
MSRKKMGLLVMAYGTPYKEEDIERYYTHIRRGRKPEPEMLQDLKDRYEAIGGISPLAQITEQQAHNLEQHLNEIQDEITFKAYIGLKHIEPFIEDAVAEMHKDGITEAVSIVLAPHFSTFSVQSYNKRAKEEAEKLGGLTITSVESWYDEPKFVTYWVDRVKETYASMPEDERENAMLIVSAHSLPEKIKEFGDPYPDQLHESAKLIAEGAGVSEYAVGWQSEGNTPDPWLGPDVQDLTRDLFEQKGYQAFVYVPVGFVADHLEVLYDNDYECKVVTDDIGASYYRPEMPNAKPEFIDALATVVLKKLGR

SEQ ID NO: 29019 - protein, 396 aa, Bacillus subtilis
  strain 168
MAKEKFDRSKSHANIGTIGHVDHGKTTLTAAITTVLHKKSGKGTAMAYDQIDGAPEERERGITISTAHVEYETETRHYAHVDCPGHADYVKNMITGAAQMDGAILVVSAADGPMPQTREHILLSKNVGVPYIVVFLNKCDMVDDEELLELVEMEVRDLLSEYDFPGDDVPVVKGSALKALEGDAEWEAKIFELMDAVDEYIPTPERDTEKPFMMPVEDVFSITGRGTVATGRVERGQVKVGDEVEIIGLQEENKKTTVTGVEMFRKLLDYAEAGDNIGALLRGVSREEIQRGQVLAKPGTITPHSKFKAEVYVLSKEEGGRHTPFFSNYRPQFYFRTTDVTGIIHLPEGVEMVMPGDNTEMNVELISTIAIEEGTRFSIREGGRTVGSGVVSTITE

SEQ ID NO: 29020 - protein, 804 aa, Bacillus subtilis
  strain 168
MSFQHKEIEKKWQTYWLENKTFATLDNNEKQKFYALDMFPYPSGAGLHVGHPEGYTATDILSRMKRMQGYDVLHPMGWDAFGLPAEQYALDTGNDPAVFTKQNIDNFRRQIQALGFSYDWDREINTTDPEYYKWTQWIFLKLYEKGLAYVDEVPVNWCPALGTVLANEEVIDGKSERGGHPVERRPMKQWMLKITAYADRLLEDLEELDWPESIKDMQRNWIGRSEGAHVHFAIDGHDDSFTVFTTRPDTLFGATYTVLAPEHALVENITTAEQKEAVEAYIKEIQSKSDLERTDLAKTKTGVFTGAYAINPVNGEKLPIWIADYVLASYGTGAVMAVPGHDERDFEFAKTFGLPVKEVVKGGNVEEAAYTGDGEHVNSDFLNGLHKQEAIEKVIAWLEETKNGEKKVTYRLRDWLFSRQRYWGEPIPVIHWEDGTSTAVPEEELPLILPKTDEIKPSGTGESPLANIKEWVEVTDPETGKKGRRETNTMPQWAGSCWYFLRYIDPHNPDQLASPEKLEKWLPVDMYIGGAEHAVLHLLYARFWHKFLYDIGVVPTKEPFQKLYNQGMILGENNEKMSKSKGNVVNPDEIVASHGADTLRLYEMFMGPLDASIAWSESGLDGARRFLDRVWRLFIEDSGELNGKIVEGAGETLERVYHETVMKVTDHYEGLRFNTGISQLMVFINEAYKATELPKEYMEGFVKLLSPVAPHLAEELWEKLGHSGTIAYEAWPVYDETKLVDDEVEIVVQLNGKVKAKLQVPADATKEQLEQLAQADEKVKEQLEGKTIRKIIAVPGKLVNIVAN

SEQ ID NO: 29021 - protein, 131 aa, Bacillus subtilis
  strain 168
MKKHGILNSHLAKILADLGHTDKIVIADAGLPVPDGVLKIDLSLKPGLPAFQDTAAVLAEEMAVEKVIAAAEIKASNQENAKFLENLFSEQEIEYLSHEEFKLLTKDAKAVIRTGEFTPYANCILQAGVLF

SEQ ID NO: 29022 - protein, 342 aa, Bacillus subtilis
  strain 168
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 29023 - protein, 149 aa, Bacillus subtilis
  strain 168
MKVIFLQDVKGKGKKGEVKNVADGYAHNFLIKKGLAVEANASNISALNGQKQKEKKEAIAELEQAKSLKETLEKLTVELSAKSGEGGRLFGSVTSKQITEQLQKDHNIKVDKRKLELPDGIRALGYTNVPVKLHPEVQAVLKVHVKEEA

SEQ ID NO: 29024 - protein, 172 aa, Bacillus subtilis
  strain 168
MLNRVVLVGRLTKDPELRYTPNGAAVATFTLAVNRTFTNQSGEREADFINCVTWRRQAENVANFLKKGSLAGVDGRLQTRNYENQQGQRVFVTEVQAESVQFLEPKNGGGSGSGGYNEGNSGGGQYFGGGQNDNPFGGNQNNQRRNQGNSFNDDPFANDGKPIDISDDDLPF

SEQ ID NO: 29025 - protein, 425 aa, Bacillus subtilis
  strain 168
MLDTKMLRANFQEIKAKLVHKGEDLTDFDKFEALDDRRRELIGKVEELKGKRNEVSQQVAVLKREKKDADHIIKEMREVGEEIKKLDEELRTVEAELDTILLSIPNIPHESVPVGETEDDNVEVRKWGEKPSFAYEPKPHWDIADELGILDFERAAKVTGSRFVFYKGLGARLERALYNFMLDLHVDEYNYTEVIPPYMVNRASMTGTGQLPKFEEDAFKIREEDYFLIPTAEVPITNMHRDEILSGDSLPINYAAFSACFRSEAGSAGRDTRGLIRQHQFNKVELVKFVKPEDSYEELEKLTNQAERVLQLLELPYRVMSMCTGDLGFTAAKKYDIEVWIPSQDTYREISSCSNFEAFQARRANIRFRREAKGKPEHVHTLNGSGLAVGRTVAAILENYQQEDGSVVIPKVLRPYMGNREVMKP

SEQ ID NO: 29026 - protein, 664 aa, Bacillus subtilis
  strain 168
MPQENNTFYITTPIYYPSGKLHIGHAYTTVAGDAMARYKRLKGFDVRYLTGTDEHGQKIQQKAEQENITPQEYVDRAAADIQKLWKQLEISNDDFIRTTEKRHKVVIEKVFQKLLDNGDIYLDEYEGWYSIPDETFYTETQLVDIERNEKGEVIGGKSPDSGHPVELIKEESYFFRMGKYADRLLKYYEENPTFIQPESRKNEMINNFIKPGLEDLAVSRTTFDWGVKVPENPKHVVYVWIDALFNYLTALGYDTENDELYQKYWPADVHLVGKEIVRFHTIYWPIMLMALDLPLPKQVFAHGWLLMKDGKMSKSKGNVVDPVTLIERYGLDELRYYLLREVPFGSDGVFTPEGFVERINYDLANDLGNLLNRTVAMINKYFDGQIGSYKGAVTEFDHTLTSVAEETVKAYEKAMENMEFSVALSTLWQLISRTNKYIDETAPWVLAKDPAKEEELRSVMYHLAESLRISAVLLQPFLTKTPEKMFEQLGITDESLKAWDSITAFGQLKDTKVQKGEPLFPRLEAEEEIAYIKGKMQGSAPAKEETKEEEPQEVDRLPEITIDQFMDVELRVAEVIEAEPVKKADRLLKLQLDLGFEKRQVVSGIAKHYTPEELVGKKLVCVTNLKPVKLRGELSQGMILAGEADGVLKVVSIDQSLPKGTRIK

SEQ ID NO: 29027 - protein, 180 aa, Bacillus subtilis
  strain 168
MMKHDIEKVLISEEEIQKKVKELGAELTSEYQDTFPLAIGVLKGALPFMADLIKHIDTYLEMDFMDVSSYGNSTVSSGEVKIIKDLDTSVEGRDILIIEDIIDSGLTLSYLVELFRYRKAKSIKIVTLLDKPSGRKADIKADFVGFEVPDAFVVGYGLDYAERYRNLPYIGVLKPAVYES

SEQ ID NO: 29028 - protein, 499 aa, Bacillus subtilis
  strain 168
MSQEEHNHEELNDQLQVRRDKMNQLRDNGIDPFGARFERTHQSQEVISAYQDLTKEELEEKAIEVTIAGRMMTKRGKGKAGFAHLQDLEGQIQIYVRKDSVGDDQYEIFKSSDLGDLIGVTGKVFKTNVGELSVKATSFELLTKALRPLPDKYHGLKDVEQRYRQRYLDLIVNPDSKHTFITRSKIIQAMRRYLDDHGYLEVETPTMHSIPGGASARPFITHHNALDIPLYMRIAIELHLKRLIVGGLEKVYEIGRVFRNEGVSTRHNPEFTMIELYEAYADYKDIMSLTENLVAHIAQEVLGTTTIQYGEEQIDLKPEWKRIHMVDAVKEATGVDFWEEVTVEQAREYAKEHEVEIKDSMTVGHIINEFFEQKIEETLIQPTFIYGHPVEISPLAKKNPEDPRFTDRFELFIVGREHANAFTELNDPIDQRERFEAQLKEREAGNDEAHLMDEDFVEALEYGMPPTGGLGIGIDRLVMLLTNAPSIRDVLLFPQMRQR

SEQ ID NO: 29029 - protein, 309 aa, Bacillus subtilis
  strain 168
MEKILIFGHQNPDTDTICSAIAYADLKNKLGFNAEPVRLGQVNGETQYALDYFKQESPRLVETAANEVNGVILVDHNERQQSIKDIEEVQVLEVIDHHRIANFETAEPLYYRAEPVGCTATILNKMYKENNVKIEKEIAGLMLSAIISDSLLFKSPTCTDQDVAAAKELAEIAGVDAEEYGLNMLKAGADLSKKTVEELISLDAKEFTLGSKKVEIAQVNTVDIEDVKKRQAELEAVISKVVAEKNLDLFLLVITDILENDSLALAIGNEAAKVEKAFNVTLENNTALLKGVVSRKKQVVPVLTDAMAE

SEQ ID NO: 29030 - protein, 366 aa, Bacillus subtilis
  strain 168
MALTAGIVGLPNVGKSTLFNAITQAGAESANYPFCTIDPNVGIVEVPDDRLQKLTELVNPKKTVPTAFEFTDIAGIVKGASKGEGLGNKFLSHIRQVDAICHVVRAFSDDNITHVSGKVDPIDDIETINLELILADMETVEKRITRVSKLAKQKDKDAVFEFEILSKLKEAFESEKPARSVEFTEEQQKLVKQLHLLTSKPILYVANVSEDEVADPSGNENVAKIREYAAGENAEVIVVCAKIESEIAELEGEEKQMFLEELGIQESGLDQLIKASYSLLGLATYFTAGEQEVRAWTFKKGMKAPECAGIIHSDFERGFIRAETVAYEDLLAGGGMAGAKEAGKVRLEGKEYVVQDGDVIHFRFNV

SEQ ID NO: 29031 - protein, 294 aa, Bacillus subtilis
  strain 168
MAQTGTERVKRGMAEMQKGGVIMDVINAEQAKIAEEAGAVAVMALERVPADIRAAGGVARMADPTIVEEVMNAVSIPVMAKARIGHIVEARVLEAMGVDYIDESEVLTPADEEFHLNKNEYTVPFVCGCRDLGEATRRIAEGASMLRTKGEPGTGNIVEAVRHMRKVNAQVRKVVAMSEDELMTEAKNLGAPYELLLQIKKDGKLPVVNFAAGGVATPADAALMMQLGADGVFVGSGIFKSDNPAKFAKAIVEATTHFTDYKLIAELSKELGTAMKGIEISNLLPEQRMQERGW

SEQ ID NO: 29032 - protein, 255 aa, Bacillus subtilis
  strain 168
MLFDTHAHLNAEQYDTDLEEVIERAKAEKVERIVVVGFDRPTITRAMEMIEEYDFIYAAIGWHPVDAIDMTEEDLAWIKELSAHEKVVAIGEMGLDYHWDKSPKDIQKEVFRNQIALAKEVNLPIIIHNRDATEDVVTILKEEGAEAVGGIMHCFTGSAEVARECMKMNFYLSFGGPVTFKNAKKPKEVVKEIPNDRLLIETDCPFLTPHPFRGKRNEPSYVKYVAEQIAELKEMTFEEIASITTENAKRLFRIN

SEQ ID NO: 29033 - protein, 437 aa, Bacillus subtilis
  strain 168
MGEREGRVDSLLDTLYNLSEEKEAFFITQKMKKLFSVKLSKSKVILVAACLLLAGSGTAYAAHELTKQSVSVSINGKKKHIRTHANTVGDLLETLDIKTRDEDKITPAKQTKITADMDVVYEAAKPVKLTINGEEKTLWSTAKTVGALLDEQDVDVKEQDQIDPAIDTDISKDMKINIEPAFQVTVNDAGKQKKIWTTSTTVADFLKQQKMNIKDEDKIKPALDAKLTKGKADITITRIEKVTDVVEEKIAFDVKKQEDASLEKGKEKVVQKGKEGKLKKHFEVVKENGKEVSRELVKEETAEQSKDKVIAVGTKQSSPKFETVSASGDSKTVVSRSNESTGKVMTVSSTAYTASCSGCSGHTATGVNLKNNPNAKVIAVDPNVIPLGSKVHVEGYGYAIAADTGSAIKGNKIDVFFPEKSSAYRWGNKTVKIKILN

SEQ ID NO: 29034 - protein, 100 aa, Bacillus subtilis
  strain 168
MNSYYDQKGSSSVPEQHDVTMKGRKHLDISGVKHVESFDNEEFLLETVMGMLSVRGQNLQMKNLDVEKGIVSIKGRVFDLVYLDEQQGDKAKGFFSKLFK

SEQ ID NO: 29035 - protein, 211 aa, Bacillus subtilis
  strain 168
MTLTTQFYTMLAMSGMGLWLGASLDTYRLFVIRAKTARWLLFIHDILFWIMQGLLFFYVLLHVNEGEFRIYIFLAVLLGVATYQSLCKRIYIKILKFVIYLVVSVYQFFKKLIQHVLFRPIVWTCGAIIWLAAFLFKKTYSLIGFLLLCLYKIVMVLCFPIRFIAKQCLKLLPVKMRLTFRRYFEKGAGFLKKKKKLLITIRTTITRFLKR

SEQ ID NO: 29036 - protein, 810 aa, Bacillus subtilis
  strain 168
MMFGRFTERAQKVLALAQEEALRLGHNNIGTEHILLGLVREGEGIAAKALQALGLGSEKIQKEVESLIGRGQEMSQTIHYTPRAKKVIELSMDEARKLGHSYVGTEHILLGLIREGEGVAARVLNNLGVSLNKARQQVLQLLGSNETGSSAAGTNSNANTPTLDSLARDLTAIAKEDSLDPVIGRSKEIQRVIEVLSRRTKNNPVLIGEPGVGKTAIAEGLAQQIINNEVPEILRDKRVMTLDMGTVVAGTKYRGEFEDRLKKVMDEIRQAGNIILFIDELHTLIGAGGAEGAIDASNILKPSLARGELQCIGATTLDEYRKYIEKDAALERRFQPIQVDQPSVDESIQILQGLRDRYEAHHRVSITDDAIEAAVKLSDRYISDRFLPDKAIDLIDEAGSKVRLRSFTTPPNLKELEQKLDEVRKEKDAAVQSQEFEKAASLRDTEQRLREQVEDTKKSWKEKQGQENSEVTVDDIAMVVSSWTGVPVSKIAQTETDKLLNMENILHSRVIGQDEAVVAVAKAVRRARAGLKDPKRPIGSFIFLGPTGVGKTELARALAESIFGDEESMIRIDMSEYMEKHSTSRLVGSPPGYVGYDEGGQLTEKVRRKPYSVVLLDEIEKAHPDVFNILLQVLEDGRLTDSKGRTVDFRNTILIMTSNVGASELKRNKYVGFNVQDETQNHKDMKDKVMGELKRAFRPEFINRIDEIIVFHSLEKKHLTEIVSLMSDQLTKRLKEQDLSIELTDAAKAKVAEEGVDLEYGARPLRRAIQKHVEDRLSEELLRGNIHKGQHIVLDVEDGEFVVKTTAKTN

SEQ ID NO: 29037 - protein, 502 aa, Bacillus subtilis
  strain 168
MSIKAEEISTLIKQQIQNYQSDIEVQDVGTVIQVGDGIARVHGLDNCMAGELVEFSNGVLGMAQNLEESNVGIVILGPFSEIREGDEVKRTGRIMEVPVGEELIGRIVNPLGQPVDGLGPILTSKTRPIESPAPGVMDRKSVHEPLQTGIKAIDALIPIGRGQRELIIGDRQTGKTSVAIDAILNQKDQDMICVYVAIGQKESTVRGVVETLRKHGALDYTIVVTASASQPAPLLYLAPYAGVTMAEEFMYNGKHVLVVYDDLSKQAAAYRELSLLLRRPPGREAFPGDVFYLHSRLLERAAKLSDAKGAGSITALPFVETQAGDISAYIPTNVISITDGQIFLQSDLFFSGVRPAINAGLSVSRVGGSAQIKAMKKVSGTLRLDLASYRELEAFAQFGSDLDQATQAKLNRGARTVEVLKQDLNKPLPVEKQVAILYALTKGYLDDIPVADIRRFEEEYYMYLDQNHKDLLDGIAKTGNLPADEDFKAAIEGFKRTFAPSN

SEQ ID NO: 29038 - protein, 473 aa, Bacillus subtilis
  strain 168
MKKGRVSQVLGPVVDVRFEDGHLPEIYNAIKISQPAASENEVGIDLTLEVALHLGDDTVRTIAMASTDGVQRGMEAVDTGAPISVPVGDVTLGRVFNVLGENIDLNEPVPADAKKDPIHRQAPSFDQLSTEVEILETGIKVVDLLAPYIKGGKIGLFGGAGVGKTVLIQELINNIAQEHGGISVFAGVGERTREGNDLFYEMSDSGVINKTAMVFGQMNEPPGARMRVALTGLTMAEHFRDVQGQDVLFFIDNIFRFTQAGSEVSALLGRMPSAVGYQPTLATEMGQLQERITSTNVGSVTSIQAIYVPADDYTDPAPATTFAHLDATTNLERKLTEMGIYPAVDPLASTSRALAPEIVGEEHYAVAREVQSTLQRYKELQDIIAILGMDELGEEDKLVVHRARRIQFFLSQNFHVAEQFTGQKGSYVPVKETVQGFKEILAGKYDHLPEDAFRLVGRIEEVVEKAKEMGVEV

SEQ ID NO: 29039 - protein, 430 aa, Bacillus subtilis; identical to SEQ ID NO: 5092
  strain 168

SEQ ID NO: 29040 - protein, 1193 aa, Bacillus subtilis
  strain 168
MTGQLVQYGRHRQRRSYARISEVLELPNLIEIQTSSYQWFLDEGLREMFQDISPIEDFTGNLSLEFIDYSLGEPKYPVEESKERDVTYSAPLRVKVRLINKETGEVKDQDVFMGDFPIMTDTGTFIINGAERVIVSQLVRSPSVYFSGKVDKNGKKGFTATVIPNRGAWLEYETDAKDVVYVRIDRTRKLPVTVLLRALGFGSDQEILDLIGENEYLRNTLDKDNTENSDKALLEIYERLRPGEPPTVENAKSLLDSRFFDPKRYDLANVGRYKINKKLHIKNRLFNQRLAETLVDPETGEILAEKGQILDRRTLDKVLPYLENGIGFRKLYPNGGVVEDEVTLQSIKIFAPTDQEGEQVINVIGNAYIEEEIKNITPADIISSISYFFNLLHGVGDTDDIDHLGNRRLRSVGELLQNQFRIGLSRMERVVRERMSIQDTNTITPQQLINIRPVIASIKEFFGSSQLSQFMDQTNPLAELTHKRRLSALGPGGLTRERAGMEVRDVHYSHYGRMCPIETPEGPNIGLINSLSSYAKVNRFGFIETPYRRVDPETGKVTGRIDYLTADEEDNYVVAQANARLDDEGAFIDDSIVARFRGENTVVSRNRVDYMDVSPKQVVSAATACIPFLENDDSNRALMGANMQRQAVPLMQPEAPFVGTGMEYVSGKDSGAAVICKHPGIVERVEAKNVWVRRYEEVDGQKVKGNLDKYSLLKFVRSNQGTCYNQRPIVSVGDEVVKGEILADGPSMELGELALGRNVMVGFMTWDGYNYEDAIIMSERLVKDDVYTSIHIEEYESEARDTKLGPEEITRDIPNVGEDALRNLDDRGIIRIGAEVKDGDLLVGKVTPKGVTELTAEERLLHAIFGEKAREVRDTSLRVPHGGGGIIHDVKVFNREDGDELPPGVNQLVRVYIVQKRKISEGDKMAGRHGNKGVISKILPEEDMPYLPDGTPIDIMLNPLGVPSRMNIGQVLELHMGMAARYLGIHIASPVFDGAREEDVWETLEEAGMSRDAKTVLYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGDNVPEPGVPESFKVLIKELQSLGMDVKILSGDEEEIEMRDLEDEEDAKQADGLALSGDEEPEETASADVERDVVTKE

SEQ ID NO: 29041 - protein, 1199 aa, Bacillus subtilis
  strain 168
MLDVNNFEYMNIGLASPDKIRSWSFGEVKKPETINYRTLKPEKDGLFCERIFGPTKDWECHCGKYKRVRYKGVVCDRCGVEVTRAKVRRERMGHIELAAPVSHIWYFKGIPSRMGLVLDMSPRALEEVIYFASYVVTDPANTPLEKKQLLSEKEYRAYLDKYGNKFQASMGAEAIHKLLQDIDLVKEVDMLKEELKTSQGQRRTRAIKRLEVLEAFRNSGNKPSWMILDVLPVIPPELRPMVQLDGGRFATSDLNDLYRRVINRNNRLKRLLDLGAPSIIVQNEKRMLQEAVDALIDNGRRGRPVTGPGNRPLKSLSHMLKGKQGRFRQNLLGKRVDYSGRSVIVVGPHLKMYQCGLPKEMALELFKPFVMKELVEKGLAHNIKSAKRKIERVQPEVWDVLESVIKEHPVLLNRAPTLHRLGIQAFEPTLVEGRAIRLHPLVCTAYNADFDGDQMAVHVPLSAEAQAEARILMLAAQNILNPKDGKPVVTPSQDMVLGNYYLTLERAGAVGEGMVFKNTDEALLAYQNGYVHLHTRVAVAANSLKNVTFTEEQRSKLLITTVGKLVFNEILPESFPYMNEPTKSNIEEKTPDRFFLEKGADVKAVIAQQPINAPFKKGILGKIIAEIFKRFHITETSKMLDRMKNLGFKYSTKAGITVGVSDIVVLDDKQEILEEAQSKVDNVMKQFRRGLITEEERYERVISIWSAAKDVIQGKLMKSLDELNPIYMMSDSGARGNASNFTQLAGMRGLMANPAGRIIELPIKSSFREGLTVLEYFISTHGARKGLADTALKTADSGYLTRRLVDVAQDVIIRETDCGTDRGILAKPLKEGTETIERLEERLIGRFARKQVKHPETGEVLVNENELIDEDKALEIVEAGIEEVWIRSAFTCNTPHGVCKRCYGRNLATGSDVEVGEAVGIIAAQSIGEPGTQLTMRTFHTGGVAGDDITQGLPRIQELFEARNPKGQATITEIDGTVVEINEVRDKQQEIVVQGAVETRSYTAPYNSRLKVAEGDKITRGQVLTEGSIDPKELLKVTDLTTVQEYLLHEVQKVYRMQGVEIGDKHVEVMVRQMLRKVRVIDAGDTDVLPGTLLDIHQFTEANKKVLLEGNRPATGRPVLLGITKASLETDSFLSAASFQETTRVLTDAAIKGKRDELLGLKENVIIGKLVPAGTGMMKYRKVKPVSNVQPTDDMVPVE

SEQ ID NO: 29042 - protein, 395 aa, Bacillus subtilis
  strain 168
MSKIIAINAGSSSLKFQLFEMPSETVLTKGLVERIGIADSVFTISVNGEKNTEVTDIPDHAVAVKMLLNKLTEFGIIKDLNEIDGIGHRVVHGGEKFSDSVLLTDETIKEIEDISELAPLHNPANIVGIKAFKEVLPNVPAVAVFDTAFHQTMPEQSYLYSLPYEYYEKFGIRKYGFHGTSHKYVTERAAELLGRPLKDLRLISCHLGNGASIAAVEGGKSIDTSMGFTPLAGVAMGTRSGNIDPALIPYIMEKTGQTADEVLNTLNKKSGLLGISGFSSDLRDIVEATKEGNERAETALEVFASRIHKYIGSYAARMSGVDAIIFTAGIGENSVEVRERVLRGLEFMGVYWDPALNNVRGEEAFISYPHSPVKVMIIPTDEEVMIARDVVRLAK

SEQ ID NO: 29043 - protein, 308 aa, Bacillus subtilis
  strain 168
MVRVANSITELIGNTPIVKLNRLADENSADVYLKLEYMNPGSSVKDRIGLAMIEAAEKEGKLKAGNTIIEPTSGNTGIGLAMVAAAKGLKAILVMPDTMSMERRNLLRAYGAELVLTPGAEGMKGAIKKAEELAEKHGYFVPQQFNNPSNPEIHRQTTGKEIVEQFGDDQLDAFVAGIGTGGTITGAGEVLKEAYPSIKIYAVEPSDSPVLSGGKPGPHKIQGIGAGFVPDILNTEVYDEIFPVKNEEAFEYARRAAREEGILGGISSGAAIYAALQVAKKLGKGKKVLAIIPSNGERYLSTPLYQFD

SEQ ID NO: 29044 - protein, 330 aa, Bacillus subtilis
  strain 168
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 29045 - protein, 327 aa, Bacillus subtilis
  strain 168
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 29046 - protein, 212 aa, Bacillus subtilis [sequence omitted]

SEQ ID NO: 29047 - protein, 153 aa, Bacillus subtilis
  strain 168
MKTENAKTNQTLVENSLNTQLSNWFLLYSKLHRFHWYVKGPHFFTLHEKFEELYDHAAETVDTIAERLLAIGGQPVATVKEYTEHASITDGGNETSASEMVQALVNDYKQISSESKFVIGLAEENQDNATADLFVGLIEEVEKQVWMLSSYLG

SEQ ID NO: 29048 - protein, 489 aa, Bacillus subtilis [sequence omitted]

SEQ ID NO: 29049 - protein, 401 aa, Bacillus subtilis
  strain 168
MTALSKSKEIIDQTSHYGANNYHPLPIVISEALGAWVKDPEGNEYMDMLSAYSAVNQGHRHPKIIQALKDQADKITLTSRAFHNDQLGPFYEKTAKLTGKEMILPMNTGAEAVESAVKAARRWAYEVKGVADNQAEIIACVGNFHGRTMLAVSLSSEEEYKRGFGPMLPGIKLIPYGDVEALRQAITPNTAAFLFEPIQGEAGIVIPPEGFLQEAAAICKEENVLFIADEIQTGLGRTGKTFACDWDGIVPDMYILGKALGGGVFPISCIAADREILGVFNPGSHGSTFGGNPLACAVSIASLEVLEDEKLADRSLELGEYFKSELESIDSPVIKEVRGRGLFIGVELTEAARPYCERLKEEGLLCKETHDTVIRFAPPLIISKEDLDWAIEKIKHVLRNA

SEQ ID NO: 29050 - protein, 382 aa, Bacillus subtilis
  strain 168
MTEEMNQIDVQVPEVGDVVKGIVTKVEDKHVDVEIINVKQSGIIPISELSSLHVEKASDVVKVDDELDLKVTKVEDDALILSKRAVDADRAWEDLEKKFETKEVFEAEVKDVVKGGLVVDIGVRGFIPASLVEAHFVEDFTDYKGKTLSLLVVELDRDKNRVILSHRAVVESEQANKKQELLQSLEVGSVLDGKVQRLTDFGAFVDIGGIDGLVHISQLSHSHVEKPSDVVEEGQEVKVKVLSVDRDNERISLSIKDTLPGPWNQIGEKVKPGDVLEGTVQRLVSFGAFVEILPGVEGLVHISQISNKHIGTPHEVLEEGQTVKVKVLDVNENEERISLSMRELEETPKADQEDYRQYQAKEETSTGFQLGDLIGDKLNKLK

SEQ ID NO: 29051 - protein, 572 aa, Bacillus subtilis
  strain 168
MNLKALPAIEGDHNLKNYEETYRHFDWAEAEKHFSWHETGKLNAAYEAIDRHAESFRKNKVALYYKDAKRDEKYTFKEMKEESNRAGNVLRRYGNVEKGDRVFIFMPRSPELYFIMLGAIKIGAIAGPLFEAFMEGAVKDRLENSEAKVVVTTPELLERIPVDKLPHLQHVFVVGGEAESGTNIINYDEAAKQESTRLDIEWMDKKDGFLLHYTSGSTGTPKGVLHVHEAMIQQYQTGKWVLDLKEEDIYWCTADPGWVTGTVYGIFAPWLNGATNVIVGGRFSPESWYGTIEQLGVNVWYSAPTAFRMLMGAGDEMAAKYDLTSLRHVLSVGEPLNPEVIRWGHKVFNKRIHDTWWMTETGSQLICNYPCMDIKPGSMGKPIPGVEAAIVDNQGNELPPYRMGNLAIKKGWPSMMHTIWNNPEKYESYFMPGGWYVSGDSAYMDEEGYFWFQGRVDDVIMTSGERVGPFEVESKLVEHPAIAEAGVIGKPDPVRGEIIKAFIALREGFEPSDKLKEEIRLFVKQGLAAHAAPREIEFKDKLPKTRSGKIMRRVLKAWELNLPAGDLSTMED

SEQ ID NO: 29052 - protein, 372 aa, Bacillus subtilis
  strain 168
MTATRGLEGVVATTSSVSSIIDDTLTYVGYDIDDLTENASFEEIIYLLWHLRLPNKKELEELKQQLAKEAAVPQEIIEHFKSYSLENVHPMAALRTAISLLGLLDSEADTMNPEANYRKAIRLQAKVPGLVAAFSRIRKGLEPVEPREDYGIAENFLYTLNGEEPSPIEVEAFNKALILHADHELNASTFTARVCVATLSDIYSGITAAIGALKGPLHGGANEGVMKMLTEIGEVENAEPYIRAKLEKKEKIMGFGHRVYKHGDPRAKHLKEMSKRLTNLTGESKWYEMSIRIEDIVTSEKKLPPNVDFYSASVYHSLGIDHDLFTPIFAVSRMSGWLAHILEQYDNNRLIRPRADYTGPDKQKFVPIEERA

SEQ ID NO: 29053 - protein, 423 aa, Bacillus subtilis
  strain 168
MAQGEKITVSNGVLNVPNNPIIPFIEGDGTGPDIWNAASKVLEAAVEKAYKGEKKITWKEVYAGEKAYNKTGEWLPAETLDVIREYFIAIKGPLTTPVGGGIRSLNVALRQELDLFVCLRPVRYFTGVPSPVKRPEDTDMVIFRENTEDIYAGIEYAKGSEEVQKLISFLQNELNVNKIRFPETSGIGIKPVSEEGTSRLVRAAIDYAIEHGRKSVTLVHKGNIMKFTEGAFKNWGYELAEKEYGDKVFTWAQYDRIAEEQGKDAANKAQSEAEAAGKIIIKDSIADIFLQQILTRPNEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGEELIKNMD

SEQ ID NO: 29054 - protein, 237 aa, Bacillus subtilis
  strain 168
MDVVEKLVINGSGSSKGGTFQSVEINGSGTVAGDVECDTFSFNGNGKADGSVKAKAVTISGSGKIHGDVEAESIRMNGTGFIQGEVSAKQLKIAGSSTFGGTVKADGIDISGKAVMEADCETETFQSEGKCKISGLLNADQVIIKLSAGESYAREIGCRHLQVTCRKGMLTLLRLMPQPVLTAELIEGDVIELTNTKAKTVRGNKVIIGPDCQIETVEYSGDYTCDPSASVETSTKL

SEQ ID NO: 29055 - protein, 235 aa, Bacillus subtilis
  strain 168
METTKLGNLKLYGAGHAAGGAYHNVSIKGEGIVGEGLSAVGCRIYGTGLFLGKAETERLRVLGESECKGDLTAGKINIYGTMKVSGSLQFDRFNLKGQTEIGGNMTGESCDVKGKLSVIGDCETEMFHVTGCVDVSGLLNSGEIKLGLSHDISHVQEIGGTTITVKRRASFFSRKKGKLIADVIEGDRVYLENTEAAVVRGKEVIIGPGCSIGTIEYEYKCECDPHSQIKEKTKL

SEQ ID NO: 29056 - protein, 296 aa, Bacillus subtilis
  strain 168
MDKTISVIGMPMDLGQARRGVDMGPSAIRYAHLIERLSDMGYTVEDLGDIPINREKIKNDEELKNLNSVLAGNEKLAQKVNKVIEEKKFPLVLGGDHSIAIGTLAGTAKHYDNLGVIWYDAHGDLNTLETSPSGNIHGMPLAVSLGIGHESLVNLEGYAPKIKPENVVIIGARSLDEGERKYIKESGMKVYTMHEIDRLGMTKVIEETLDYLSACDGVHLSLDLDGLDPNDAPGVGTPVVGGISYRESHLAMEMLYDAGIITSAEFVEVNPILDHKNKTGKTAVELVESLLGKKLL

SEQ ID NO: 29057 - protein, 433 aa, Bacillus subtilis
  strain 168
MRMVDIIIKKQNGKELTTEEIQFFVNGYTDGSIPDYQASALAMAIFFQDMSDRERADLTMAMVNSGETIDLSAIEGIKVDKHSTGGVGDTTTLVLAPLVAALDVPVAKMSGRGLGHTGGTIDKLEAIMGFHVELTKDEFIKLVNRDKVAVIGQSGNLTPADKKLYALRDVTGTVNSIPLIASSIMSKKIAAGADAIVLDVKTGAGAFMKTEEDAAELAKAMVRIGNNVGRQTMAVISDMSQPLGFAIGNALEVKEAIDTLKGEGPEDLHELVLTLGSQMVVLAKKADTLDEARAKLEEVMKNGKALEKFKDFLKNQGGDSSIVDDPSKLPQAAYQIDVPAKEAGVVSEIVADEIGVAAMLLGAGRATKEDEIDLAVGIMLRKKVGDKVEKGEPLVTLYANRENVDEVIAKVYDNIRIAAEAKAPKLIHTLITE

SEQ ID NO: 29058 - protein, 415 aa, Bacillus subtilis
  strain 168
MKHLPAQDEQVFNAIKNERERQQTKIELIASENFVSEAVMEAQGSVLTNKYAEGYPGKRYYGGCEHVDVVEDIARDRAKEIFGAEHVNVQPHSGAQANMAVYFTILEQGDTVLGMNLSHGGHLTHGSPVNFSGVQYNFVEYGVDKETQYIDYDDVREKALAHKPKLIVAGASAYPRTIDFKKFREIADEVGAYFMVDMAHIAGLVAAGLHPNPVPYADFVTTTTHKTLRGPRGGMILCREEFGKKIDKSIFPGIQGGPLMHVIAAKAVSFGEVLQDDFKTYAQNVISNAKRLAEALTKEGIQLVSGGTDNHLILVDLRSLGLTGKVAEHVLDEIGITSNKNAIPYDPEKPFVTSGIRLGTAAVTSRGFDGDALEEVGAIIALALKNHEDEGKLEEARQRVAALTDKFPLYKELDY

SEQ ID NO: 29059 - protein, 149 aa, Bacillus subtilis
  strain 168
MKVAIASDHGGVHIRNEIKELMDELQIEYIDMGCDCGSGSVDYPDYAFPVAEKVVSGEVDRGILICGTGIGMSISANKVKGIRCALAHDTFSAKATREHNDTNILAMGERVIGPGLAREIAKIWLTTEFTGGRHQTRIGKISDYEEKNL

SEQ ID NO: 29060 - protein, 126 aa, Bacillus subtilis
  strain 168
MAKRIDHTGIMVRDINASITFYEEVLGMKLKDRITHTNGVIELAFLGFEDGPETEIELIQGYSSELPAEGKVHHIALLTDDIAAEYTKAEKMNAKFIDEEITTLPNGYRYFYIEGPDGEWIEFFQR

SEQ ID NO: 29061 - protein, 249 aa, Bacillus subtilis
  strain 168
MNNTIETILNHRSIRSFTDQLLTAEEIDTLVKSAQAASTSSYVQAYSIIGVSDPEKKRELSVLAGNQPYVEKNGHFFVFCADLYRHQQLAEEKGEHISELLENTEMFMVSLIDAALAAQNMSIAAESMGLGICYIGGIRNELDKVTEVLQTPDHVLPLFGLAVGHPANLSGKKPRLPKQAVYHENTYNVNTDDFRHTMNTYDKTISDYYRERTNGKREETWSDQILNFMKQKPRTYLNDYVKEKGFNKN

SEQ ID NO: 29062 - protein, 515 aa, Bacillus subtilis
  strain 168
MTVTYAHEPFTDFTEAKNKTAFGESLAFVNTQLGKHYPLVINGEKIETDRKIISINPANKEEIIGYASTADQELAEKAMQAALQAFDSWKKQRPEHRANILFKAAAILRRRKHEFSSYLVKEAGKPWKEADADTAEAIDFLEFYARQMLKLKEGAPVKSRAGEVNQYHYEALGVGIVISPFNFPLAIMAGTAVAAIVTGNTILLKPADAAPVVAAKFVEVMEEAGLPNGVLNYIPGDGAEIGDFLVEHPKTRFVSFTGSRAVGCRIYERAAKVQPGQKWLKRVIAEMGGKDTVLVDKDADLDLAASSIVYSAFGYSGQKCSAGSRAVIHQDVYDEVVEKAVALTKTLTVGNPEDPDTYMGPVIHEASYNKVMKYIEIGKSEGKLLAGGEGDDSKGYFIQPTIFADVDENARLMQEEIFGPVVAICKARDFDHMLEIANNTEYGLTGALLTKNRAHIERAREDFHVGNLYFNRGCTGAIVGYQPFGGFNMSGTDSKAGGPDYLILHMQAKTTSEAF

SEQ ID NO: 29063 - protein, 254 aa, Bacillus subtilis
  strain 168
MSEQQMTNEAAKTLDGWYALHDFRTMDWASWKLLSSDERQSIIHEFTGLLEKWGVAQKEGKGSQTLYSIVGQKADFMLMILRPTMEELNQIELEFNKSRLAEFTIPAYSYVSVVELSNYLASGDGDPYENPHVRARLYPELPESKYVCFYPMDKRRSGNDNWYMLSMEERRNLMRSHGLIGRSYAGKVKQIITGSVGFDDYEWGVTLFSDDVLQFKKLVYEMRFDEVSARYGEFGSFFVGNHLSLDTLPQFLYV

SEQ ID NO: 29064 - protein, 323 aa, Bacillus subtilis
  strain 168
MADLFSTVQEKVAGKDVKIVFPEGLDERILEAVSKLAGNKVLNPIVIGNENEIQAKAKELNLTLGGVKIYDPHTYEGMEDLVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVADAVKIAKEKAPELTLDGEFQFDAAFVPSVAEKKAPDSEIKGDANVFVFPSLEAGNIGYKIAQRLGNFEAVGPILQGLNMPVNDLSRGCNAEDVYNLALITAAQAL

SEQ ID NO: 29065 - protein, 270 aa, Bacillus subtilis
  strain 168
MLKGLYTATSAMIAQQRRTEMLSNNIANANTSGYKADQGSMRAFPEMLLSRIESKSPAGTSRTEIGSVNTGVYMQELKPLFTQGSLKSTDQPTDIALIENQVPMSAETNEKAALFYPVQTADGIRYSKSSTFSLNENNQLTINGRPILSTDRQPITVDNENFTVSENGTVTTNGRTAGQIDVRMAEDVRNLKRDGNDLYSTADGNDLPSAAGNNQVAYSLKQGVSELSNVDVTSAYTEMTEAYRSFEANQKVIQAYDKSMDKAANEIGKI

SEQ ID NO: 29066 - protein, 410 aa, Bacillus subtilis
  strain 168
MDSFSQKLNTYAQLAVEVGVNVQKGQYVVVNASTDVRDFVRLIVKHAYEKGAKNVTVNWQDDEVAKLKYELAPFEAFEEYPEWEAKGREELAKNGAAFISVVSSNPDLLKGIDSKRIAAFQKAAGKALHTYRQYIQSDKVSWTVVGAASAGWAHKVFPGKSEEEAIHLLWEEIFKATRVNEDNPVQAWINHDQNLHEKVDHLNERHYAALHYQAEGTDLTIKLPRKHVWAGAGSVNESGHEFMANMPTEEVFTLPQKDGVDGVVSSTKPLSYGGNIIENFTLTFENGRIVDIKAEKGEDILKELVETDEGSHYLGEVALVPYDSPISQSNILFYNTLFDENASNHLAIGSAYAFNIEGGKQMSREELVKEGLNESITHVDFMIGSKDMNIDGITADGKREPIFRNGNWAF

SEQ ID NO: 29067 - protein, 430 aa, Bacillus subtilis
  strain 168
MKTTINQVYKHVGEEVTIGAWVANKRSSGKIAFLQLRDGTGFIQGVVVKAEVEESIFQTAKSVTQETSLYIKGIVKEDERSPLGYELAVTDIEVIHEATDYPITPKEHGTEFLMDHRHLWLRSKRQHAIMKIRNEIIRATYEFFNNEGFVKVDPPILTGSAPEGTTELFATKYFDEDAYLSQSGQLYMEAAAMALGKVFSFGPTFRAEKSKTKRHLIEFWMIEPEMAFVEFEENLQVQENYVSFIVQSVLKNCKIELNTLGRDTSKLEQIKAPFPRITYDEAIEFLKEKGFDDIEWGDDFGAPHETAIAEHYDKPVFITRYPTSLKPFYMQPASDREDVVLCADLIAPEGYGEIIGGSERIHDMELLESRLKEHGLDSDAYKWYAELRKYGSVPHSGFGLGLERTVAWISGAPHVRETIPFPRLLNRLYP

SEQ ID NO: 29068 - protein, 511 aa, Bacillus subtilis
  strain 168
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 29069 - protein, 259 aa, Bacillus subtilis
  strain 168
MALLQKTRIINSMLQAAAGKPVNFKEMAETLRDVIDSNIFVVSRRGKLLGYSINQQIENDRMKKMLEDRQFPEEYTKNLFNVPETSSNLDINSEYTAFPVENRDLFQAGLTTIVPIIGGGERLGTLILSRLQDQFNDDDLILAEYGATVVGMEILREKAEEIEEEARSKAVVQMAISSLSYSELEAIEHIFEELDGNEGLLVASKIADRVGITRSVIVNALRKLESAGVIESRSLGMKGTYIKVLNNKFLIELENLKSH

SEQ ID NO: 29070 - protein, 914 aa, Bacillus subtilis
  strain 168
MSDQFNSREARRKANSKSSPSPKKGKKRKKGGLFKKTLFTLLILFVLGVVGGAVTFAVMVSDAPSLDESKLKTPYSSTIYDKNGKEIAEVGAEKRTYVSIDEIPDVVKEAFIATEDARFYEHHGIDPVRIGGALVANFKDGFGAEGGSTITQQVVKNSLLSHQKTLKRKVQEVWLSIQLERNYSKDEILEMYLNRIYFSPRAYGIGKAAEEFFGVTDLSKLTVEQAATLAGMPQSPTAYNPVKNPDKAEKRRNIVLSLMKKQGFISDSQYNKAKKVAVKDEGVVSQKEYEKASTNKYSAFVEEVMKEIDEKSDVDPSADGLKIYTTLDTKAQDKLDELMDGDTVGFTEGMQGGVTLLDTKNGEVRAIGAGRNQPVGGFNYATQTKAQPGSTIKPILDYGPVIENKKWSTYEQIDDSAYTYSNGKPIRDWDRKYLGPISMRYALAQSRNIPALKAFQAVGKDTAVDFANGLGLGLTKDNVTEAYSIGGFGGNDGVSPLTMAGAYSAFGNNGTYNEPHFVKSIEFNDGTKLDLTPKSKSAMSDYTAFMITDMLKTAVKTGTGQLAQVPGVEVAGKTGTTNFDDNEVKRYNIASGGARDSWFVGYTPQYTAAVWTGMGENEAGKKSLSAEEQKVAKRIFAQLIADVDDGSGSFEKPDSVVEATVEKGSNPAKLAGPNTPSDKKLTEYFVKGTAPSTVSKTYEKEEKEETAKLSGLNVKYDKDNQSLTLSWNYDGDATFAVKQSVDGGSYSEIQNSSAKEAVISGVQPGSVYKFEVTAVSDDGKSTASTSYEVPKAEDDEDKKDQQQTDDEKQDDEKTQDDTQTDDSQKDDGQTDQDQTDDSTNDQDKKQDNTNTNPSDNNNQDQSNDNDNDNSNNQDTSDGDSNSGKNDSTGSDTNKNKTDTSNKTQTNSSSIEKTN

SEQ ID NO: 29071 - protein, 561 aa, Bacillus subtilis
  strain 168
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWFREAISSIDSPYRDFYIWKKPQENGSVPTNWESKFGGSAWELDEASGQYYLHLFDVTQADLNWENEEVRKHVYDMMHFWFEKGIDGFRLDVINLISKDQRFPNAEEGDGRSFYTDGPRVHEFLHEMNEKVFSHYDSMTVGEMSSTTVDHCIRYTNPDNKELDMTFSFHHLKVDYPNGEKWALAPFDFLKLKEILSDWQTGMHAGGGWNALFWCNHDQPRVVSRYGDDGAYRVKSAKMLATAIHMMQGTPYIYQGEELGMTNPKFTDISSYRDVESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTLRPYESIVYRLTKPC

SEQ ID NO: 29072 - protein, 279 aa, Bacillus subtilis
  strain 168
MVKYQYEFPLDKAGKAGAVKPYRGGKNDFVTPVSNLSGVAEILTNAALKATEAYSQLGQDRLGAVLISKVKGWAYADREGTLFIEESDNNNVWTTTAAVNVAAGVLTATDWVYLSKRYYRFRYVNGNLQQSEFVLYQSVGAGEMDVRVNEKTPLQIDFAENQTHDGRLKVEARKTFDFVFHENAESASEGAALPVDGAAHLLVEVYGTAEMSEVKFWGKSVSGQKLPIRGVKTDDATTASSTLGKAEAWAFDIKGFKEIIMEIISITGGTLSVKGTAVS

SEQ ID NO: 29073 - protein, 88 aa, Bacillus subtilis
  strain 168
MKINQFGTQSVNPYQKNYDKQAVQKTVAQPQDKIEISSQAKEMQHASDAVTGSRQEKIAQLKAQIENGSYKVDANHIAKNMINFYKKQ

SEQ ID NO: 29074 - protein, 691 aa, Bacillus subtilis
  strain 168
MSDYLVIVESPAKAKTIERYLGKKYKVKASMGHVRDLPKSQMGVDIEQNFEPKYITIRGKGPVLKELKTAAKKAKKVYLAADPDREGEAIAWHLAHSLDLDLNSDCRVVFNEITKDAIKESFKHPRMINMDLVDAQQARRILDRLVGYKISPILWKKVKKGLSAGRVQSVALRLIIDREKEINDFKPEEYWTIDGTFLKGQETFEASFFGKNGKKLPLNSEADVKEILSQLKGNQYTVEKVTKKERKRNPALPFTTSTLQQEAARKLNFRAKKTMMIAQQLYEGIDLGREGTVGLITYMRTDSTRISNTAVDEAAAFIDQTYGKEFLGGKRKPAKKNENAQDAHEAIRPTSVLRKPSELKAVLGRDQMRLYKLIWERFVASQMAPAVLDTMSVDLTNNGLTFRANGSKVKFSGFMKVYVEGKDDQMEEKDRMLPDLQEGDTVLSKDIEPEQHFTQPPPRYTEARLVKTLEERGIGRPSTYAPTLDTIQRRGYVALDNKRFVPTELGQIVLDLIMEFFPEIINVEFTAKMERDLDHVEEGNTEWVKIIDNFYTDFEKRVKKAESEMKEVEIEPEYAGEDCELCSSPMVYKMGRYGKFLACSNFPDCRNTKPIVKQIGVKCPSCGEGNIVERKSKKKRVFYGCDRYPDCEFVSWDKPIERKCPKCGKMLVEKKLKKGIQVQCVECDYKEEPQK

SEQ ID NO: 29075 - protein, 415 aa, Bacillus subtilis
  strain 168
MSEVSVKAKLAKEAAAEMIMKTTAEKDEALSLIANGLRKELDFLLAENAKDIVNGKENGLTPDIIDRLSLDEKRIRDIADAVELLIDLADPIGDSLETIEKENGLFIEKIRVPLGVVGMIYEARPNVTVDAATLCLKTGNAVVLRGSSSAIHSNKALVSVIYRALEQSALPIHAVQLIEDTSRETAKELFTLNDGLDVLIPRGGKKLIDLVVRESTVPVLETGAGNCHIFIDETAKPQMAEKVVVNAKTQRPSVCNAIESLLIHKAWARQHGKELLDQLENAGVEIRGDELVCELHPSSKQASKEDWETEFLAPVLSVKTVENVQEAVKHIQQYGTNHSEAILTENDKNAVYFQTAVDAAAVYHNASTRFTDGFEFGYGAEIGISTQKLHARGPMGLPALTSTKYIIKGTGQIRE

SEQ ID NO: 29076 - protein, 325 aa, Bacillus subtilis
  strain 168
MANFIEKITYLGTPAIKAGNEHLEMIVVPEWGSNVISLVDKTTNVQLLREPETAESFHDTPTLYGIPILFPPNRISDGTFSFRGRTYHFDINEKDKHNHLHGFLYHEKWNVVTTKQTDEGVIVETEIDLSELPHVQKQFPHHAVVRMTYTIKENTLFKHATVMNKGKEAFPWGIGYHTTFIFPAESSLFSLTADQQWELDERLLPTGKLMDVPYKEALHEGMDLRHKQLDDVFLSSYQKRGGENQAVIYHQHAHISIIYKADEQFKHWVVYNADGKQGYLCPEPYTWVTNAVNLDLPSSLTGLQVLEPGEETTAKSSITIELNHQ

SEQ ID NO: 29077 - protein, 2555 aa, Bacillus subtilis
  strain 168
MPQQPEIQDIYPLSFMQEGMLFHSLYDEQSRAYFEQASFTIHGQLDLERFQKSMDAVFDRYDIFRTAFIYKNVAKPRQVVLKQRHCPIHIEDISHLNERDKEHCTEAFKEQDKSKGFDLQTDVLMRISILKWAPDHYVCIWSHHHILMDGWCLGIVIKDFLHIYQALGKGQLPDLPPVQPYGTYIKWLMQQDREEAAEYWKKRLQHFEKSTPLPKRTDQIPNGTLQQITFAIPEKETAELQKIAAASGATLNTVFQALWGIMLQKVNRSSDAVFGSVISGRPSELKDVENMVGLFINTIPIRAQSDSLSFSDLVRRMQKDMNEAEAYSYFPLYDIQAQSALKQELIDHIIVFENTPTQQEIEELNQAGSFDFSVKDFEMEEVTNYSCSVKVIPGRTLYVRIHFQTSAYQPSMMSEIKDYLLHMVSDVISDPSLPVSKMTLLDEDKTRKIVSQNNRTVSVSPEAPTLHGLFERQAAVTPERLAIRFSGGSLTYAELDMYASRLAAHLAARGVTNESIVGVLSERSPDMLIAVLAVLKAGGAYLPLDPAYPKERLSYMLKDSGASLLLTQPGCSAPNFSGETLEVDMTSLECEEVKRHVSASVSDGSLAYVIYTSGSTGQPKGVAVEHRQAVSFLTGMQHQFRLSEDDIVMVKTSFSFDASVWQLFWWALSGASAYLLPPGWEKDSALIVQAIHQENVTTAHFIPAMLNSFLDQAEIERLSDRTSLKRVFAGGEPLAPRTAARFASVLPQVSLIHGYGPTEATVDAAFYVLDPERDRDRLRIPIGKPVPGARLYVLDPHLAVQPSGVAGELYIAGAGVARGYLNRPALTEERFLEDPFYLGERMYKTGDVARWLPDGNVEFLGRTDDQVKIRGYRIEPGEIEAALRSIEGVREAAVTVRTDSGEPELCAYVEGLQRNEVRAQLQRLLPGYMVPAYMIEMEQWPVTPSGKLDRNALPAPGGAADAETYTAPRNVTEMKLSQLWEDVLKNGPVGIHDNFFDRGGHSLKATALVSRIAKEFDVQVPLKDVFAHPTVEGLATVIREGTDSPYEAIKPAEKQETYPVSSAQKRIYVLQQLEDGGTGYNMPAVLELEGKLNLERMDRAFKELIKRHESLRTAFEQDAGGDPVQRIHDEVPFTLQTTVLGARTEEEAAAAFIKPFDLSQAPLFRAQIVKVSDERHLLLVDMHHIISDGVSVNILIREFGELYNNRKLPALRIQYKDYAVWQEGFKTGDAYKTQGAYWLKQLEGELPVLDLPADHARPPMRSFAGDKVSFTLDQEVTSGLYKLARENGSTLYMVLLAAYTAFLSRLSGQEDIIVGSPIAGRPHKDLEPILGMFVNTLALRTRPEGGKPFVQYLQEVRETAMEAFEHQDYPFEELVDKLELTRDMSRNPLFDVMFVLQNMDQESLELDELCLKPAANNGHQTSKFDLTLYAQEQPRGLLTFQMEFSTDLYKKKTIEKWLQYFNNMLLSIIKDNKAALGTINILNEDEAHYLIHELNRTKIDYPRNETISRLFEMQAEQTPNAVAIVSDTQVFTYEDLNSWANQIASVLQIKGVGPDSVVALLTGRTPELIAGMLGILKAGGAYLPIDSNLPVERIAYMLSDSRAALLLQSEKTEKRLLGIECEQIIIEDIQKQGEAKNVESSAGPHSLAYIIYTSGSTGKPKGVMIEQRSVIRLVKNSNYITFTPEDRLLMTSSIGFDVGSFEIFGPLLNGAALHLSDQQTFLDSHQLKRYIEHQGITTIWLTSSLFNHLTEQNEQTFSQLKHLIIGGEALSPSHVNRIRNVCPEVSIWNGYGPTENTTFSTCLHIQKTYELSIPIGRPVGNSTAFILNQWGVLQPVGAVGELCVGGDGVARGYLGRPDLTKEKFVPHPFAPGDRLYRTGDLARWLSDGTIEYVGRIDDQVKVRGYRVELGEIETALRQIDGVKEAAVLARTAQTGSKELFGYISVKAGTNAEQVRSLLARSLPNYMIPAYIIEMETLPLTSNGKLNRKALPEPDVASKQTYIPPRNELEEQLALIWQEVLGIQRIGIEDSFFELGGDSIKALQVSARLGRYGLSLQVSDLFRHPKIKDLSPFIRKSERIIEQGPIQGDVPWTPVQQWFFSQDIEERHHFNQSVMLFHSGRLSENALRPALKKLAEHHDALRMVYRNDDRRWIQINQGIHESQLYSLRISDLSQSESGWETKIKQEVADLQQSINLQEGPLLHAALFKTLTGDYLFLAIHHLVVDGVSWRILLEDLSAGYQQAAAGQTIQLPPKTDSYQEYARRIQEYAQSSKLIREEAYWRSVEEQQAAELPYEIPHHVNIDFSKRDSLSFSLTEADTAVLLQNVNHAYGTDTQDILLTAASLAICEWTGGSKLRIAMEGHGREHILPELDISRTVGWFTSMYPALISFENHRDELGTSVKTVKDTLGRIPNKGVGYGMLKYLTHPENKSITFSKTPEISFNYLGQFNDIERQDTFRPSSLGSGKDITHTWKREQIIEMSAMAADKKLHFNLSYPPARFHRNTMEQLINRIEHFLLDIMKHCAGQQKAEKTLSDFSSQSLTAEDLDSISSLVEEL

SEQ ID NO: 29078 - protein, 538 aa, Bacillus subtilis
  strain 168
MRNLTKTSLLLAGLCTAAQMVFVTHASAEESIEYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSVTPSISEKKAIHTARRELEASIGKIEYLDGEPKGELYIYPHDGEYDLAYLVRLSTSEPEPGYWHYFIDAKNGKVIESFNAIHEAAGTGIGVSGDEKSFDVTEQNGRFYLADETRGKGINTFDAKNLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSASVEKAYEAVGIL

SEQ ID NO: 29079 - protein, 358 aa, Bacillus subtilis
  strain 168
MSNTELELLRQKADELNLQILKLINERGNVVKEIGKAKEAQGVNRFDPVRERTMLNNIIENNDGPFENSTIQHIFKEIFKAGLELQEEDHSKALLVSRKKKPEDTIVDIKGEKIGDGQQRFIVGPCAVESYEQVAEVAAAAKKQGIKILRGGAFKPRTSPYDFQGLGVEGLQILKRVADEFDLAVISEIVTPAHIEEALDYIDVIQIGARNMQNFELLKAAGAVKKPVLLKRGLAATISEFINAAEYIMSQGNDQIILCERGIRTYETATRNTLDISAVPILKQETHLPVFVDVTHSTGRRDLLLPTAKAALAIGADGVMAEVHPDPSVALSDSAQQMAIPEFEKWLNELKPMVKVNA

SEQ ID NO: 29080 - protein, 469 aa, Bacillus subtilis
  strain 168
MSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEAREAIADGVELIGYTSWGPIDLVSASTAEMKKRYGFIYVDRDNEGNGTFNRIKKKSFNWYQQVIATNGESL

SEQ ID NO: 29081 - protein, 394 aa, Bacillus subtilis
  strain 168
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 29082 - protein, 382 aa, Bacillus subtilis
  strain 168
MKVPKTMLLSTAAGLLLSLTATSVSAHYVNEEHHFKVTAHTETDPVASGDDAADDPAIWVHEKHPEKSKLITTNKKSGLVVYDLDGKQLHSYEFGKLNNVDLRYDFPLNGEKIDIAAASNRSEGKNTIEVYAIDGDKGKLKSITDPNHPISTNISEVYGFSLYHSQKTGAFYALVTGKQGEFEQYEIVDGGKGYVTGKKVREFKLNSQTEGLVADDEYGNLYIAEEDEAIWKFNAEPGGGSKGQVVDRATGDHLTADIEGLTIYYAPNGKGYLMASSQGNNSYAMYERQGKNRYVANFEITDGEKIDGTSDTDGIDVLGFGLGPKYPYGIFVAQDGENIDNGQAVNQNFKIVSWEQIAQHLGEMPDLHKQVNPRKLKDRSDG

SEQ ID NO: 29083 - protein, 378 aa, Bacillus subtilis
  strain 168
MSQQTTPAEQKSLQRKKPPFRADQVGSLLRSEPVKKARLQKAAGEMTAEQLRQIENDEIIRIVEKQKETGLNVVTDGEFRRAWWHFDFLENLDGVEPFTPEQGIQFHNVQTKARGIKVTGDIDFSTHPMLEDYSFLHSIAGDATPKMTIPSPNMLFFRGKLEKDEYKNDYQLFQHDVSKAYKKAIQAFYDRGCRYLQLDDTAWAVFLSEKGLKQIEAFGTTPDELRQLFAKSINDAIADRPDDLTVTMHICRGNFQSTWTAEGGYDAAAETIFDGLNLDGLFLEYDDSRSGGFEPLRYVKRSDLQLVLGLVTSKFGELENPDDVKRRIEEASRYVSLDQLCLSPQCGFASTEEGNKLTEEQQWAKLRHVVEIANDVWK

SEQ ID NO: 29084 - protein, 377 aa, Bacillus subtilis
  strain 168
MAQQTNVAGQKTEKQRKAPFRADHVGSLLRSVPVKEARQKKAAGEMTAEQLRDIENQEITRIVEKQKEIGLDVVTDGEFRRSWWHYDFLEGLDGVEPFIPAEGIQFHNTKTKARSIKVTGKLDFTSHPALGDYQFLHEIAGNATPKLTIPSPNMLFFGEKADKGIYDDQEEYFHDMAQAYKKAIKAFYDAGCRYLQLDDTSWSLFFEDKGREVVRALGGDPETLPAIFAKTINDAVADRPDDLTITMHICRGNFRSTWAASGGYDAVAETILDGLNLDGLFLEYDDDRSGNFDPLRFVKRKDLQIVLGLITSKYGELENPEDVKRRINEAARFVSLDQLCLSPQCGFASTEEGNLLTEEQQWAKLRHVIDIANDVWR

SEQ ID NO: 29085 - protein, 289 aa, Bacillus subtilis
  strain 168
MKLALDPSMYRDDLTLEEMVYKTAELGYEYIELSPREDFCPFYKYPKVDSAKIKQLKRLLRDTGVKLSSLLPLYHWAGPDEDRRQAAVRNWKRAIEIAVELEVDLMNSEFSGSKYDPLTSEEKFIKSMDELLPVFEKEGIKLNLQAHPYDFIETHKGAMDMIRALDKDWINLVYSTAHTFFYDDGKGDIETMFDEAGDRLTHVLFADTYNHKAAHGLRYIVNPPDAKVTVHQHLDIGQGEVDFDTIFRKLREMKFDGIATNAVFAWVDERADESSRFMLKKMKEELGLA

SEQ ID NO: 29086 - protein, 209 aa, Bacillus subtilis
  strain 168
MTKGILGRKIGMTQVFAENGDLIPVTVIEAAPNVVLQKKTAENDGYEAIQLGFDDKREKLSNKPEKGHVAKAETAPKRFVKELRGVEMDAYEVGQEVKVEIFSAGEIVDVTGVSKGKGFQGAIKRHGQSRGPMSHGSRYHRRPGSMGPVDPNRVFKGKLLPGRMGGEQITVQNLEIVKVDAERNLLLIKGNVPGAKKSLITVKSAVKSK

SEQ ID NO: 29087 - protein, 166 aa, Bacillus subtilis
  strain 168
MSSAIETKKVVVEEIASKLKESKSTIIVDYRGLNVSEVTELRKQLREANVEFKVYKNTMTRRAVEQAELNGLNDFLTGPNAIAFSTEDVVAPAKVLNDFAKNHEALEIKAGVIEGKVSTVEEVKALAELPSREGLLSMLLSVLQAPVRNLALAAKAVAEQKEEQGA

SEQ ID NO: 29088 - protein, 300 aa, Bacillus subtilis
  strain 168
MQRIQLAEDLQFSRVIHGLWRLNEWNYSDAELLSLIEWCIDHGITTFDHADIYGGYTCEKLFGNALALSPGLRENIELVTKCGIVLESPERPAHRSHHYNTSKSHILASVEQSLMNLRTDYIDMLLIHRPDPLMDPEGVAEAFQALKCSGKVRYFGVSNFKDHQYRMLESYLPEKLVTNQIELSAYELENMLDGTLNLCQEKRIPPMAWSPLAGGKVFTENTDKDRRVRTALESVQGEIGAASLDEVMYAWLYTHPAGIMPIVGSGKRERISAAINALSYKLDQDQWFRIFTAVQGYDIP

SEQ ID NO: 29089 - protein, 509 aa, Bacillus subtilis
  strain 168
MVLDANIKAQLNQYMQLIENDIVLKVSAGEDDTSKDMLALVDELASMSSKISVEKAELNRTPSFSVNRVGEDTGVTFAGIPLGHEFTSLVLALLQVSGRPPKVDQKVIDQVKKISGEYHFESYISLTCHNCPDVVQALNMMSVLNPNITHTMIDGAAYKAEVESKNIMAVPTVYLNGESFGSGRMTLEEILAKMGSGTDASEFADKEPFDVLVVGGGPAGASAAIYTARKGIRTGVVAERFGGQVLDTMSIENFISVKATEGPKLAASLEEHVKEYDIDVMNLQRAKRLEKKDLFELELENGAVLKSKTVILSTGARWRNVNVPGEQEFKNKGVAYCPHCDGPLFEGKDVAVIGGGNSGIEAAIDLAGIVNHVTVLEFAPELKADEVLQKRLYSLPNVTVVKNAQTKEITGDQSVNGITYVDRETGEEKHVELQGVFVQIGLVPNTEWLEGTVERNRMGEIIVDKHGATSVPGLFAAGDCTDSAYNQIIISMGSGATAALGAFDYLIRN

SEQ ID NO: 29090 - protein, 267 aa, Bacillus subtilis
  strain 168
MSNETIKLVIAGPRGRMGQEAVKLAERTPHFDLVGAIDHTYDQQKLSDVMPVESDAFIYTDIHACFTETQPDVLIDLTTPEIGKVHTKIALEHGVRPVVGTTGFSEADLKELTSLTEEKGIGAIIAPNFALGAILMMKFSKMAANYFEDVEIIELHHDQKLDAPSGTALKTAEMISEVRKEKQQGHPDEKEILPGARGAEQNGIRLHSVRLPGLIAHQEVMFGMDGQTLQIRHDSYNRASFMSGVKLSVEQVMKIDQLVYGLENIID

SEQ ID NO: 29091 - protein, 136 aa, Bacillus subtilis
  strain 168
MKKWMAGLFLAAAVLLCLMVPQQIQGASSYDKVLYFPLSRYPETGSHIRDAIAEGHPDICTIDRDGADKRREESLKGIPTKPGYDRDEWPMAVCEEGGAGADVRYVTPSDNRGAGSWVGNQMSSYPDGTRVLFIVQ

SEQ ID NO: 29092 - protein, 55 aa, Bacillus subtilis
  strain 168
MQDLINYFLNYPEALKKLKNKEACLIGFDVQETETIIKAYNDYYLADPITRQWGD

SEQ ID NO: 29093 - protein, 86 aa, Bacillus subtilis
  strain 168
MEILKVSAKSSPNSVAGALAGVLRERGAAEIQAIGAGALNQAVKAVAIARGFVAPSGVDLICIPAFTDIQIDGEERTAIKLIVEPR

SEQ ID NO: 29094 - protein, 667 aa, Bacillus subtilis
  strain 168
MDTIEKKSVATIRTLSIDAIEKANSGHPGMPMGAAPMAYTLWTKFMNVSPANPGWFNRDRFVLSAGHGSALLYSMLHLSGFDLSIEDLKGFRQWGSKTPGHPEFGHTAGVDATTGPLGQGIAMAVGMAIAERHLAETYNRDSFNVVDHYTYSICGDGDLMEGISSEAASLAGHLQLGRLIVLYDSNDISLDGDLDRSFSENVKQRFEAMNWEVLYVEDGNNIEELTAAIEKARQNEKKPTLIEVKTTIGFGSPNRAGTSGVHGAPLGKEESKLTKEAYAWTYEEDFYVPSEVYEHFAVAVKESGEKKEQEWNAQFAKYKEVYPELAEQLELAIKGELPKDWDQEVPVYEKGSSLASRASSGEVLNGLAKKIPFFVGGSADLAGSNKTTIKNAGDFTAVDYSGKNFWFGVREFAMGAALNGMALHGGLRVFGGTFFVFSDYLRPAIRLAALMGLPVTYVFTHDSIAVGEDGPTHEPVEQLASLRAMPNLSLIRPADGNETAAAWKLAVQSTDHPTALVLTRQNLPTIDQTSEEALAGVEKGAYVVSKSKNETPDALLIASGSEVGLAIEAQAELAKENIDVSVVSMPSMDRFEKQSDEYKNEVLPADVKKRLAIEMGSSFGWGKYTGLEGDVLGIDRFGASAPGETIINEYGFSVPNVVNRVKALINK

SEQ ID NO: 29095 - protein, 416 aa, Bacillus subtilis
  strain 168
MEFPKKAEIIAVGSELLLGQIANTNAQFISKQLAEIGVNVFYHTAVGDNPERLKQVIRIAEERSDFIIFSGGLGPTKDDLTKETIANTLGRPLVLNDEAFQSIEDYFKRTKRTMSPNNRKQALVIEGSDVLANHFGMAPGMLTEHESRYYMLLPGPPSELRPMFENEAKPLLLKKMGSNEKIVSTVLRFFGIGESQLEADLEDIIDAQTNPTIAPLAADGEVTLRLTAKHADEKETERLLKETEAVILERVGEFFYGYDDTSLVKELSIACKEKGITISAAESFTGGLFSEWLTDHSGASKLFAGGVVCYTNDVKQNVLGVKKETLDRFGAVSKECASELAKGVQKLTGSDIGISFTGVAGPDAQEGHEPGHVFIGISANGKEEVHEFHFAGSRTGIRKRGAKYGCHLILKLLEQK

SEQ ID NO: 29096 - protein, 330 aa, Bacillus subtilis
  strain 168
MSAVTESVLESIISPVTMSEFLEEYWPVKPLVARGEVERFTSIPGFEKVRTLENVLAIYNNPVMVVGDAVIEESEGITDRFLVSPAEALEWYEKGAALEFDFTDLFIPQVRRWIEKLKAELRLPAGTSSKAIVYAAKNGGGFKAHFDAYTNLIFQIQGEKTWKLAKNENVSNPMQHYDLSEAPYYPDDLQSYWKGDPPKEDLPDAEIVNLTPGTMLYLPRGLWHSTKSDQATLALNITFGQPAWLDLMLAALRKKLISDNRFRELAVNHQSLHESSKSELNGYLESLIQTLSENAETLTPEQIFQSQDSDFDPYQSTQLVFRQLLTSYKF

SEQ ID NO: 29097 - protein, 310 aa, Bacillus subtilis
  strain 168
MKKAKLGKSDLQVFPIGLGTNAVGGHNLYPNLNEETGKELVREAIRNGVTMLDTAYIYGIGRSEELIGEVLREFNREDVVIATKAAHRKQGNDFVFDNSPDFLKKSVDESLKRLNTDYIDLFYIHFPDEHTPKDEAVNALNEMKKAGKIRSIGVSNFSLEQLKEANKDGLVDVLQGEYNLLNREAEKTFFPYTKEHNISFIPYFPLVSGLLAGKYTEDTTFPEGDLRNEQEHFKGERFKENIRKVNKLAPIAEKHNVDIPHIVLAWYLARPEIDILIPGAKRADQLIDNIKTADVTLSQEDISFIDKLFA

SEQ ID NO: 29098 - protein, 394 aa, Bacillus subtilis
  strain 168
MPAYKYNRVFLIVMDSVGIGEAPDAADFNDEGAHTLGHIAEHMNGLHMPNMAKLGLGLIEDIKGVEKTEHPLAYYGKMQEASNGKDTMTGHWEIMGLYIDKPFKVFPEGFPDELLQELEKRSGRKIIGNKPASGTAILDELGQEHMETGALIVYTSADSVLQIAAHEEVVPLEELYRICETARELTLDPKYMVGRIIARPFVGEPGQFKRTPNRHDYALKPFDRTVMNELKDCGLDVISIGKISDIYDGEGITSSRRTVSNMDGMDKVIDTLGEDFTGLSFANLVDFDALFGHRRDPEGYGRALEEFDARLPEVFEKMREDDLLIITADHGNDPIHHGTDHTREYVPILAYSKKHKKAQMLPLADTFADIGATIADNFQTNKPKYGKSFLSLLQ

SEQ ID NO: 29099 - protein, 271 aa, Bacillus subtilis
  strain 168
MKDRIERAAAFIKQNLPESPKIGLILGSGLGILADEIENPVKLKYEDIPEFPVSTVEGHAGQLVLGTLEGVSVIAMQGRFHFYEGYSMEKVTFPVRVMKALGVEALIVTNAAGGVNTEFRAGDLMIITDHINFMGTNPLIGPNEADFGARFPDMSSAYDKDLSSLAEKIAKDLNIPIQKGVYTAVTGPSYETPAEVRFLRTMGSDAVGMSTVPEVIVANHAGMRVLGISCISNAAAGILDQPLSHDEVMEVTEKVKAGFLKLVKAIVAQYE

SEQ ID NO: 29100 - protein, 556 aa, Bacillus subtilis
  strain 168
MNIAEQMKDVLKEEIKAAVLKAGLAEESQIPNVVLETPKDKTHGDYSTNMAMQLARVAKKAPRQIAEEIVAHFDKGKASIEKLDIAGPGFINFYMNNQYLTKLIPSVLEAGEAYGETNIGNGERVQVEFVSANPTGDLHLGHARGAAVGDSLCNVLSKAGYDVSREYYINDAGNQINNLALSVEVRYFEALGLEKPMPEDGYRGEDIIAIGKRLAEEYGDRFVNEEESERLAFFREYGLKYELEKLRKDLENFRVPFDVWYSETSLYQNGKIDKALEALREKGHVYEEDGATWFRSTTFGDDKDRVLIKKDGTYTYLLPDIAYHKDKLDRGFDKLINVWGADHHGYIPRMKAAIEALGYEKGTLEVEIIQLVHLYKNGEKMKMSKRTGKAVTMRDLIEEVGLDAVRYFFAMRSADTHMDFDLDLAVSTSNENPVYYAQYAHARICSMLRQGEEQGLKPAADLDFSHIQSEKEYDLLKTIGGFPEAVAEAAEKRIPHRVTNYIYDLASALHSFYNAEKVIDPENEEKSRARLALMKATQITLNNALQLIGVSAPEKM

SEQ ID NO: 29101 - protein, 185 aa, Bacillus subtilis
  strain 168
MISVNDFRTGLTIEVDGGIWRVVDFQHVKPGKGAAFVRSKLRNLRTGAIQEKTFRAGEKVAKAQIETKTMQYLYANGDQHVFMDTSSYEQLELSATQIEEELKYLLENMSVHIMMYQDETLGIELPNTVELKVVETEPGIKGDTASGGTKPAKTETGLVVNVPFFVNEGDTLVVNTSDGSYVSRA

SEQ ID NO: 29102 - protein, 312 aa, Bacillus subtilis
  strain 168
MGNTRKKVSVIGAGFTGATTAFLIAQKELADVVLVDIPQLENPTKGKALDMLEASPVQGFDAKITGTSNYEDTAGSDIVVITAGIARKPGMSRDDLVSTNEKIMRSVTQEIVKYSPDSIIVVLTNPVDAMTYAVYKESGFPKERVIGQSGVLDTARFRTFVAEELNLSVKDVTGFVLGGHGDDMVPLVRYSYAGGIPLETLIPKERIDAIVERTRKGGGEIVNLLGNGSAYYAPAASLTEMVEAILKDQRRVLPTIAYLEGEYGYEGIYLGVPTIVGGNGLEQIIELELTDYERAQLNKSVESVKNVMKVLS

SEQ ID NO: 29103 - protein, 172 aa, Bacillus subtilis
  strain 168
METPETRFCKESKVVKTSRVFPLDTNNHNTLFGGKLMSYIDDIASISAARHCRRETVTASMDSVDFLKPIGQKDSVCLESYVTWVGTSSMEVFVKVIKEHLMTGERELAATSFLTFVALDSNGKPVPVPRVVPETEEEIMLHNTAVQRANERKNRKRHSQALANALGTDKPW

SEQ ID NO: 29104 - protein, 700 aa, Bacillus subtilis
  strain 168
MSQNQVPKWIQLNNEIMIQKDGKFQFDKDKEAVHSYFVDYINQNTVFFHNLKEKLDYLVENQYYEEEFLSLYSFEDIKEVFKTAYAKKFRFPSFMSAFKFYNDYALKTNDKKKILERYEDRISIVALFFANGDTEKAKEYVNLMINQEYQPSTPTFLNAGRKRRGELVSCFLLEVNDSLNDISRAIDISMQLSKLGGGVSLNLSKLRAKGEAIKDVENATKGVVGVMKLLDNAFRYADQMGQRQGSGAAYLNIFHRDINDFLDTKKISADEDVRVKTLSIGVVIPDKFVELAREDKAAYVFYPHTIYKEYGQHMDEMDMNEMYDKFVDNPRVKKEKINPRKLLEKLAMLRSESGYPYIMFQDNVNKVHANNHISKVKFSNLCSEVLQASQVSSYTDYDEEDEIGLDISCNLGSLNILNVMEHKSIEKTVKLATDSLTHVSETTDIRNAPAVRRANKAMKSIGLGAMNLHGYLAQNGIAYESPEARDFANTFFMMVNFYSIQRSAEIAKEKGETFDQYEGSTYATGEYFDKYVSTDFSPKYEKIANLFEGMHIPTTEDWKKLKAFVAEHGMYHSYRLCIAPTGSISYVQSSTASVMPIMERIEERTYGNSKTYYPMPGLASNNWFFYKEAYDMDMFKVVDMIATIQQHIDQGISFTLFLKDTMTTRDLNRIDLYAHHRGIKTIYYARTKDTGQDSCLSCVV

SEQ ID NO: 29105 - protein, 275 aa, Bacillus subtilis
  strain 168
MENRYSVHPEQVKRFTTEELRSHFLMDSLFTENKLTMYYSHEDRVVIGGAAPGQSELKLDAGDFLKTDFFLERREIGIINVGQPGAVRVGDDEYVLQTKDFLYIGMGNQDVSFSSLNGEKAKFYFVSACAHKSYPTQKAALSELTPDRLGDDAASNVRSLYKVIHQDGIKSCQLMMGITMLDQNNNWNTMPAHVHDRRMEAYLYLDLEKDSKVFHFMGQPDETRHLVVGNEQAVLSPAWSIHSGAGTSNYSFVWAMAGENYTFTDMDLIPMDGLK

SEQ ID NO: 29106 - protein, 501 aa, Bacillus subtilis
  strain 168
MEIHTYEKEFFDLLKRISHYSEAVALMHWDSRTGAPKNGSEDRAESIGQLSTDIFNIQTSDRMKELIDVLYERFDDLSEDTKKAVELAKKEYEENKKIPEAEYKEYVILCSKAETAWEEAKGKSDFSLFSPYLEQLIEFNKRFITYWGYQEHPYDALLDLFEPGVTVKVLDQLFAELKEAIIPLVKQVTASGNKPDTSFITKAFPKEKQKELSLYFLQELGYDFDGGRLDETVHPFATTLNRGDVRVTTRYDEKDFRTAIFGTIHECGHAIYEQNIDEALSGTNLSDGASMGIHESQSLFYENFIGRNKHFWTPYYKKIQEASPVQFKDISLDDFVRAINESKPSFIRVEADELTYPLHIIIRYEIEKAIFSNEVSVEDLPSLWNQKYQDYLGITPQTDAEGILQDVHWAGGDFGYFPSYALGYMYAAQLKQKMLEDLPEFDALLERGEFHPIKQWLTEKVHIHGKRKKPLDIIKDATGEELNVRYLIDYLSNKYSNLYLL

SEQ ID NO: 29107 - protein, 705 aa, Bacillus subtilis
  strain 168
MGQEKHVFTIDWAGRTLTVETGQLAKQANGAVMIRYGDTAVLSTATASKEPKPLDFFPLTVNYEERLYAVGKIPGGFIKREGRPSEKAVLASRLIDRPIRPLFADGFRNEVQVISIVMSVDQNCSSEMAAMFGSSLALSVSDIPFEGPIAGVTVGRIDDQFIINPTVDQLEKSDINLVVAGTKDAINMVEAGADEVPEEIMLEAIMFGHEEIKRLIAFQEEIVAAVGKEKSEIKLFEIDEELNEKVKALAEEDLLKAIQVHEKHAREDAINEVKNAVVAKFEDEEHDEDTIKQVKQILSKLVKNEVRRLITEEKVRPDGRGVDQIRPLSSEVGLLPRTHGSGLFTRGQTQALSVCTLGALGDVQILDGLGVEESKRFMHHYNFPQFSVGETGPMRGPGRREIGHGALGERALEPVIPSEKDFPYTVRLVSEVLESNGSTSQASICASTLAMMDAGVPIKAPVAGIAMGLVKSGEHYTVLTDIQGMEDALGDMDFKVAGTEKGVTALQMDIKIEGLSREILEEALQQAKKGRMEILNSMLATLSESRKELSRYAPKILTMTINPDKIRDVIGPSGKQINKIIEETGVKIDIEQDGTIFISSTDESGNQKAKKIIEDLVREVEVGQLYLGKVKRIEKFGAFVEIFSGKDGLVHISELALERVGKVEDVVKIGDEILVKVTEIDKQGRVNLSRKAVLREEKEKEEQQS

SEQ ID NO: 29108 - protein, 237 aa, Bacillus subtilis
  strain 168
MRKKLKWLSFLLGFIILLFLFKYQFSNNDSWKPWSLPLSGKIIYLDPGHGGPDGGAVGGKLLEKDVTLEVAFRVRDYLQEQGALVIMTRESDTDLAPEGTKGYSRRKAEDLRQRVKLINHSEAELYISIHLNAIPSQKWSGAQSFYYGKYAENEKVAKYIQDELRRNLENTTRKAKRIHGIYLMQNVTKPGALIEVGFLSNPSEATLLGKPKYQDKVASSIYKGILRYFTEKGDPPE

SEQ ID NO: 29109 - protein, 66 aa, Bacillus subtilis
  strain 168
MQNGKVKWFNNEKGFGFIEVEGGDDVFVHFTAIEGDGYKSLEEGQEVSFEIVEGNRGPQASNVVKL

SEQ ID NO: 29110 - protein, 246 aa, Bacillus subtilis
  strain 168
MLNDKTAIVTGASRGIGRSIALDLAKSGANVVVNYSGNEAKANEVVDEIKSMGRKAIAVKADVSNPEDVQNMIKETLSVFSTIDILVNNAGITRDNLIMRMKEDEWDDVININLKGVFNCTKAVTRQMMKQRSGRIINVSSIVGVSGNPGQANYVAAKAGVIGLTKSSAKELASRNITVNAIAPGFISTDMTDKLAKDVQDEMLKQIPLARFGEPSDVSSVVTFLASEGARYMTGQTLHIDGGMVM

SEQ ID NO: 29111 - protein, 377 aa, Bacillus subtilis
  strain 168
MKIKSIEPTPSPNTMKVILTEELPAGKSNNYKPEQAEGAPLVIAEILKIDGVKGVYHVADFLAVERNARYDWKDILPQVRTAFGMESAESAEENRSDQESFGEVKVFVQMFSGIPMQVKLTDGEREERFGLPERFQQAILKLRSEASNVVFERAWKEQGVRFGDFDEIGHDVTEELQAAYSDERLKRLTEAAAQGKGEAKQAVQRKAYKVTLDMLDDEDWKKRYAHLEQMDPKEEDIPVLQKALDDPKVSIRRQAVVYLGMIETPDVLPLLYKALEDKAVSVRRTAGDCLSDIGDPQAIPAMIKSLSDSSKLVRWRAAMFLYEVGDESAIEALRAAEDDPEFEVSLQVKMALERIEHGEEAKGSVWKQMTESRKKGE

SEQ ID NO: 29112 - protein, 466 aa, Bacillus subtilis
  strain 168
MNGGTFTTGKEKERAGIYFNFKTTAQERVSLSERGTVALPVASSWGEAKTFVSISSVEDLNKKVGLSIDDPSLLLLREAKKNAKTVLMYRLTEGVRASADIAEGVKATAVYGGTKGNDIIIRINQNVLDANSFDVTTYMDESEVDKQTVKKAEELTANGYVTFTGTGDLSSTIPLTGSEGDTAAETLNASAGIRLSGGTDKAPVNSDYTDFLAAAETESFDVIALPVAEGDQLKATFAAFIKRLRDGQGQKVQGVTANYAGDYEGIINVTEGVLLEDGTEVTPDKATAWVAGASAGATFNQSLTFVEYEGAVDVLHRLDHDTIVERLGKGEFLFTFDARDKSVSVEKDINSLVTFTAEKNKKFAKNKIVRVLDAVNNDLTRELKALIKSRKGSGSDIPASEDGLQYVKTMITQYMTTLQDAGGITGFDSDEDITISMNEDRDGFLIDLAVQPVDAAEKFYFNVEVN

SEQ ID NO: 29113 - protein, 1332 aa, Bacillus subtilis
  strain 168
MAKLTARFDLEDKVSKKLKRIHKGFQEVEKKVKTINRQIKISIRAEDQAFYRLRKINDYIILKFAKSLEIKVVLDDQVTSKLDAIERKLKRLPKETKLTVSLVDRTAAAYKKIKKMLSNQKLSFLLIPDDKVTSTVKRIIGYIKKNLKNGYTVKLKVIDEITKTVNRLTALLRKFEKTYYVKVVVKTKISDKINKKESLINKETSKKESDKSSDKGSDKNSDQKPGWVGKIKGWLKDWWTKSAWPWIKDTLNEIGKAFLDRFKERLIEKLKNDVFDKIIDKILGPQKKDDSGENSDTDKKVLNRNTGGNCCCDCCEGGISPGTKNKKTYRKKKSPTKAPNRTLKVPGEVIRRRQSGTPAESAPRTSGSKLKNWLGGLKSLGKDSSKLGKAFRGMGKAVPYVGSALAVFDLAGINKDNAGEKVGSIGGRIAGAEAGATAGAEAGATIGSFVGPEGTAIGGAIGGIGGGLVGGIGGEEAGKNIGKMFDTSKLKESISNSLFNKEWWSGKWNSISDTANGAITWIEDTWSKVSTWFDQYVFTPIYNVAVPVINFIVGLFAYAWDGILAVWNIVYPWFKDNVWDPISGAVTNVATTIWTGLCNAWTVISGIWSTVSTWFMDNVWNPVSEAVTTAATWIWSKINDAWTIISNIWTGVSNWFYDNVWNPIVKKVEDIKTSIKEKFDDARKFFEDAWDGIETWFNEHVKDPLVKVSEKIAEKFQWLFDLKDSVGGFVAKVIHRGEEVTHLKKKPIKKDSKEKKTSSKPTTNNIFAQSPSNNNMTVFQQALDQNATGGYITKPTISWIGEAGKEFVIPVDNNRGRGKMLLSQAASKLGMQVVDDMGAASSSGGSPASVSGGAAVSPLSGTASPVMNTANLTGQASTLGQQFSEGFGKGISDQPVKMEDWKKKNINTPFTQMISASPNYGKQMVSGYAKGQSGTATGTDGFLQSKVKTPFQATVSKSSSWGTGTVKGFAQGQNSTQTGTAQYVSTHVDKPFLRSKDTSNSWGSGLIGNFVTGMNSKSSEVKQAAKDMAKRVEQAFREELDIHSPSRVMMSLGRFASVGVVKGLDSVDVKKYAEKQAGSLAAAYSGMGAVGGNVKQWLMAAIMATKTPLSWLSGLMTIAQYESGGNPNSINLWDSNAKAGNPSQGLMQTVPTTFNAHKAPGMGNIRNPIHNAAAAIGYIKSRYGSIDNVPGIKSLKRGGPYVGYANGGLITKEQIARVGEGNKREWIIPEERGIRGRYLLQRAAQALGMEVTDPSQSQQSELSSGQVSAVTSASRPTAAVSGSKEIYIQFNGDQHFHNGQDAESLAAKIKQALIDELQKDINIGTKGVVAFD

SEQ ID NO: 29114 - protein, 202 aa, Bacillus subtilis
  strain 168
MAYELPELPYAYDALEPHIDKETMTIHHTKHHNTYVTNLNKAVEGNTALANKSVEELVADLDSVPENIRTAVRNNGGGHANHKLFWTLLSPNGGGEPTGALAEEINSVFGSFDKFKEQFAAAAAGRFGSGWAWLVVNNGKLEITSTPNQDSPLSEGKTPILGLDVWEHAYYLNYQNRRPDYISAFWNVVNWDEVARLYSEAK

SEQ ID NO: 29115 - protein, 448 aa, Bacillus subtilis [sequence omitted]

SEQ ID NO: 29116 - protein, 488 aa, Bacillus subtilis
  strain 168
MSNQDQALIFELSREGRIGYSLPELDVPEIELGDLLSDTYIRDEDAALPEVSELDIMRHYTALSKRNHGVDSGFYPLGSCTMKYNPKINEKIARIPGFAAIHPLQDEDTVQGALELLYDLSKHLEEITGMDEVTLQPAAGAHGEWTGLMMIRAYHEARGDFKRTKVIVPDSAHGTNPASATVAGFETVTVKSNEKGLVDLEDLKRAVNEETAALMLTNPNTLGLFEEQITEMAEIVHQAGGKLYYDGANLNAVLSKARPGDMGFDVVHLNLHKTFTGPHGGGGPGSGPVGVKQDLIPYLPKPVLVKKEGRFTFDYDRPHAIGRVKPYYGNFGINVRAYTYIRSMGPDGLKAVTENAVLNANYMMRKLAPYYDLPFDRHCKHEFVLSGKRQKKLGVRTLDIAKRLLDFGYHPPTIYFPLNVEECIMIEPTETESKETLDAFIDAMIQIAKEAEENPELVQEAPHTTIVKRMDETKAARHPVLRYEAEER

SEQ ID NO: 29117 - protein, 679 aa, Bacillus subtilis
  strain 168
MSKQDLLLEIGLEEMPARFLNESMVQLGDKLTGWLKEKNITHGEVKLFNTPRRLAVFVKDVAEKQDDIKEEAKGPAKKIALDADGNWTKAAIGFSKGQGANVEDLYIKEVKGIEYVFVQKFQAGQETKSLLPELSGLITSLHFPKNMRWGNEDLRYIRPIKWIVALFGQDVIPFSITNVESGRTTQGHRFLGHEVSIESPSAYEEQLKGQHVIADPSVRKQMIQSQLETMAAENNWSIPVDEDLLDEVNHLVEYPTALYGSFESEFLSIPEEVLVTTMKEHQRYFPVKDKNGDLLPHFITVRNGNSHAIENVARGNEKVLRARLSDASFFYKEDQKLNIDANVKKLENIVFHEELGSLADKVRRVTSIAEKLAVRLQADEDTLKHVKRAAEISKFDLVTHMIYEFPELQGIMGEKYARMLGEDEAVAAAVNEHYMPRSAGGETPSTFTGAVVAMADKLDTIASFFSIGVIPTGSQDPYGLRRQASGIVAILLDRNWGISFEELLTFVQTDKENELLDFFTQRLKYVLNAEQIRHDVIDAVLESSELEPYSALHKAQVLEQKLGAPGFKETAEALGRVISISKKGVRGDIQPDLFENEYEAKLFDAYQTAKQNLQENFSKKDYEAALASLAALKEPIDAYFDHTMVIADNESLKANRLAQMVSLADEIKSFANMNALIVK

SEQ ID NO: 29118 - protein, 527 aa, Bacillus subtilis
  strain 168
MNSVDLTADLQALLTCPNVRHNLSAAQLTEKVLSRNEGILTSTGAVRATTGAYTGRSPKDKFIVEEESTKNKIDWGPVNQPISEEAFERLYTKVVSYLKERDELFVFEGFAGADEKYRLPITVVNEFAWHNLFARQLFIRPEGNDKKTVEQPFTILSAPHFKADPKTDGTHSETFIIVSFEKRTILIGGTEYAGEMKKSIFSIMNFLLPERDILSMHCSANVGEKGDVALFFGLSGTGKTTLSADADRKLIGDDEHGWSDTGVFNIEGGCYAKCIHLSEEKEPQIFNAIRFGSVLENVVVDEDTREANYDDSFYTENTRAAYPIHMINNIVTPSMAGHPSAIVFLTADAFGVLPPISKLTKEQAMYHFLSGYTSKLAGTERGVTSPETTFSTCFGSPFLPLPAHVYAEMLGKKIDEHGADVFLVNTGWTGGGYGTGERMKLSYTRAMVKAAIEGKLEDAEMITDDIFGLHIPAHVPGVPDHILQPENTWTNKEEYKEKAVYLANEFKENFKKFAHTDAIAQAGGPLV

SEQ ID NO: 29119 - protein, 250 aa, Bacillus subtilis
  strain 168
MVTIKKDFIPVSNDNRPGYAMAPAYITVHNTANTAKGADAKMHAKFVKNPNTSESWHFTVDDSVIYQHLPIDENGWHAGDGTNGTGNRKSIGIEICENADGDFEKATSNAQWLIRKLMKENNIPLNRVVPHKKWSGKECPRKLLDHWNSFLNGISSSDTPPKETSPSYPLPSGVIKLTSPYRKGTNILQLQKALAVLHFYPDKGAKNNGIDGVYGPKTANAVKRFQLMNGLTADGIYGPKTKAKLKSKLK

SEQ ID NO: 29120 - protein, 373 aa, Bacillus subtilis
  strain 168
MAKSVNGQQIIQLFEQFSPKAYAVEGDKIGLQIGTLNKPIKNVMVTLDVLESVIDEAIEKEVDLIIAHHPPIFRSLKHISTDQPAGRLIEKCLKHDIAVYAAHTNLDVADGGVNDLLAEALELSETEVLAPTYTDPLKKLAVYVPKEYEEQVRAALGNAGAGHIGEYSHCAFSSEGIGSFKPLDGAKPFIGEVGELELVHEVRLETVFPKSVEKAVINAMIKSHPYEEVAYDIYPVEQTPAEKGLGRVGTLKNEMTLKEFALFVKDKLDVNGVRMVGDADSMVKKVAVLGGDGNKYIHHAKRKGADVYVTGDLYFHVAHDAMMLGLNVVDPGHYAEKIMKEGVTRKLTSMCNDKKFGVNIFVSETDTNPFTFL

SEQ ID NO: 29121 - protein, 297 aa, Bacillus subtilis
  strain 168
MLRIGSHVSMSGKHMLLAASQEAVSYGANTFMIYTGAPQNTRRKKIEDLNIEAGRAHMQENGIDEIIVHAPYIINIGNTTNPSTFELGVDFLRSEIERTAAIGAKQIVLHPGAHVGAGAEAGIKKIIEGLNEVIDPNQNVQIALETMAGKGSECGRSFEELAQIIEGVTHNEQLSVCFDTCHTHDAGYNIVEDFDGVLNEFDKIIGIDRIKVLHINDSKNVKGARKDRHENIGFGEIGFDALQYVVHHEQLKDIPKILETPYVGEDKKNKKPPYRFEIEMLKEKQFDDTLLEKILQQ

SEQ ID NO: 29122 - protein, 716 aa, Bacillus subtilis
  strain 168
MRRNKPKKQNHKEKKKSLPIRLNILFLAAFVIFTWIIVELGIKQIVQGDDYKNQANKQEQSEVSSAVPRGKIYDRNFNAIVTNKALNAITYTRSKSTTQEQRLKIAKKLSDMIKVDTKKVTERDKKDYWILTRPKEAKKLISSKERQQVEDKKISDDDLYQLQLKRITDKQLNELTDKDMQILAIKRQMDSGYALTPQYIKNEDVSAKEMAVVSEHLDELPGVDVTSDWEREYPYKNLLRSVLGSVSSSNEGLPSNLLDHYLSLGYSRNDRVGKSYLEYQYESLLQGQKAKVENITDSKGNVTGTKTVSEGKAGKDLVLTIDIDLQKSVEKIIEKKLKAAKARPSTELLDRAFVVMMDPRNGEVLTMAGKQIKRENGAYKFDDYALGAMTSSYAMGSAVKGATVLTGLQTGAINLNTVFKDEPLYIGQDKRGKKSWQNLGPVGIQTALEKSSNVFMFKTAIAVGKGEYKPHQALPLDTSAFDTFRNYFSQFGLGVKTGIDLPNEMTGYKGTSRLSGFLLDFAIGQYDTYTPLELAQYVSTIANGGYRMKPQLVKEVRDSNAKKGIGAVVDSVQPEVLNKVDMKSSYIEEVQAGFRRVATKGTAAGQLASASYKPAAKTGTAQSFYDGPDKSKTGTDTYNTTLVAYAPADNPEIAISVVVPWTYIDYNQRYSITNEIGREVMDKYFELKSKQDKEGTQQKNKDKIEENAENTTSSDN

SEQ ID NO: 29123 - protein, 321 aa, Bacillus subtilis
  strain 168
MDEIWFAGIDLGGTTIKLAFINQYGEIQHKWEVPTDKTGDTITVTIAKTIDSKLDELQKPKHIIKYIGMGAPGPVDMAAGVVYETVNLGWKNYALKNHLETETGIPAVIENDANIAALGEMWKGAGDGAKDVILVTLGTGVGGGIIANGEIVHGINGAGGEIGHICSIPEGGAPCNCGKTGCIETIASATGIVRIAKEKIANAKKTTRLKATEQLSARDVFEAAGENDEIALEVVDYVAKHLGLVLGNLASSLNPSKIVLGGGVSRAGELLRSKVEKTFRKCAFPRAAQAADISIAALGNDAGVIGGAWIAKNEWLKHQNC

SEQ ID NO: 29124 - protein, 353 aa, Bacillus subtilis
  strain 168
MKLEKLRNLFGQLGIDGMLITSNTNVRYMTGFTGSAGLAVISGDKAAFITDFRYTEQAKVQVKGFEIIEHGGSLIQTTADTVESFGIKRLGFEQNSMTYGTYASYSAVISDAELVPVAESVEKLRLIKSSEEIKILEEAAKIADDAFRHILTFMKPGISEIAVANELEFYMRSQGADSSSFDMIVASGLRSSLPHGVASDKLIESGDLVTLDFGAYYKGYCSDITRTVAVGQPSDQLKEIYQVVFDAQALGVAHIKPGMTGKEADALTRDHIAAKGYGDYFGHSTGHGLGMEVHESPGLSVRSSAILEPGMVVTVEPGIYIPETGGVRIEDDIVITENGNRTITHSPKELIIL

SEQ ID NO: 29125 - protein, 372 aa, Bacillus subtilis
  strain 168
MNPKYKPLFEPFTFKSGVTINNRIAVAPMTHYASNEDGTISEAELDYIIPRSKEMGMVITACANVTPDGKAFPGQPAIHDDSNIPGLKKLAQAIQAQGAKAVVQIHHGGIECPSELVPQQDVVGPSDVFDNGKQIARALTEEEVENIVKAFGEATRRAIEAGFDGVEIHGANGYLIQQFYSPKTNQRTDRWGGSDEKRLAFPLAIVDEVKKAASEHAKGAFLVGYRLSPEEPETPGLTMTETYTLVDALGDKELDYLHISLMDVNSKARRGADPTRTRMDLLNERVGNKVPLIAVGSIHSADDALAVIENGIPLVAMGREILVDPNWTVKVKEGREKQIETVIKGTDKEKYHLPEPLWQAIVNTQGWVPYKD

SEQ ID NO: 29126 - protein, 299 aa, Bacillus subtilis
  strain 168
MKLKDLIGKASIHKNKTIAVAHAEDEEVIRAVKLAAEHLSARFLLTGDSKKLNELTSSMQGHQVEIVHANTPEESAKLAVRAVHHKTADVLMKGNVPTSVLLKAVLNRQEGLRSASVLSHVAVFDIPDFDRLMFVTDSAMNIAPSLEELRQILQNAVHVAHAVGNNMPKAAALAAVETVNPKMEATVNAAALAQMYKRGQIKGCIVDGPLALDNAVSQIAAAQKKISGDVAGNADILLVPTIEAGNILYKSLIYFAKASVAAVITGAKAPIALTSRADSAENKLYSIALAICASEEYTH

SEQ ID NO: 29127 - protein, 364 aa, Bacillus subtilis
  strain 168
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 29128 - protein, 363 aa, Bacillus subtilis
  strain 168
MKVLHDEKRILTINPGSTSTKIGVFHNERSIFEKTLRHNIEELQRFDRIIDQYEFRKNHILETLHEQGINISKFDAVCARGGLLRPIEGGTYVVNDEMIEDLKSGYAGQHASNLGGIIAREIADGLNIPSYIVDPVVVDEMSVLAKVSGMPEIERKSIFHALNQKAVARKAAASLGKRYENMKMIITHMGGGITIGVHDRGRVVDVNNGLHGEGPFSPERAGTVPAGDLVDLCFSGEYTKEEIMKKLVGTGGLLGYLGTNDAVKVEQMIQGGDEKARFIYDAMAYQVAKEIGAASAALKGEVEAIVLTGGLAYGKSFVSAIRSYIDWISDVLVYPGENELQSLAQGALRVLQGEEQSKQYRIE

SEQ ID NO: 29129 - protein, 474 aa, Bacillus subtilis
  strain 168
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 29130 - protein, 371 aa, Bacillus subtilis
  strain 168
MVNEKRLLEEFLELVQIDSETKHEAEICKVLKRKFSDLGVDVKEDDTMDITGHGAGNLICTLKGTKQTDTIYFTSHMDTVVPGNGVKPVVENGYVKTDGTTILGADDKAGLAAMFEAIKVLKEENIEHGTIEFIITVGEESGLIGAKALDRSMITASYGYALDSDGKVGNIIVAAPTQAKVRAAIFGKTAHAGVEPEKGISAITIASKAISKMPLGRIDEETTANIGRFEGGTQTNIVCDEVHILAEARSLVPEKMEAQVQKMKAAFEEAAADMGGRAEVEIEVMYPGFKYQDGDQVVEIAKKAAAKIGRPSELQTSGGGSDANVIAGHGIPTVNLAVGYEQIHTKNEKMPIEELVKTAEMVVAIIEEAAK

SEQ ID NO: 29131 - protein, 489 aa, Bacillus subtilis
  strain 168
MKTNQQPKAVIVIFGATGDLAKRKLYPSIHRLYQNGQIGEEFAVVGVGRRPWSNEDLRQTVKTSISSSADKHIDDFTSHFYYHPFDVTNPGSYQELNVLLNQLEDTYQIPNNRMFYLAMAPEFFGTIAKTLKSEGVTATTGWSRLVIEKPFGHDLPSAQALNKEIREAFTEDQIYRIDHYLGKQMVQNIEVIRFANAIFEPLWTNRYISNIQITSSESLGVEDRARYYEKSGALRDMVQNHIMQMVALLAMEPPIKLNTEEIRSEKVKVLRALRPIAKDEVDEYFVRGQYHAGEIDGVPVPAYTDEDNVAPDSNTETFVAGKLLIDNFRWAGVPFYIRTGKRMKEKSTKIVVQFKDIPMNLYYGNENNMNPNLLVIHIQPDEGITLYLNAKKLGGAAHAQPIKLDYCSNCNDELNTPEAYEKLIHDCLLGDATNFAHWDEVALSWSFVDSISETWAANKTLSPNYESGSMGPKESDDLLVKDGLHWWNI

SEQ ID NO: 29132 - protein, 338 aa, Bacillus subtilis
  strain 168
MARKLFTPITIKDMTLKNRIVMSPMCMYSSHEKDGKLTPFHMAHYISRAIGQVGLIIVEASAVNPQGRITDQDLGIWSDEHIEGFAKLTEQVKEQGSKIGIQLAHAGRKAELEGDIFAPSAIAFDEQSATPVEMSAEKVKETVQEFKQAAARAKEAGFDVIEIHAAHGYLIHEFLSPLSNHRTDEYGGSPENRYRFLREIIDEVKQVWDGPLFVRVSASDYTDKGLDIADHIGFAKWMKEQGVDLIDCSSGALVHADINVFPGYQVSFAEKIREQADMATGAVGMITDGSMAEEILQNGRADLIFIGRELLRDPFFARTAAKQLNTEIPAPVQYERGW

SEQ ID NO: 29133 - protein, 439 aa, Bacillus subtilis
  strain 168
MIAKHMIRTLMIETPSVPGNLGRVATAIGLLGGDIGEVETVKVGPNYTMRNITVQVENEEQLQEVIAAVQALGEGIRLHTVSDEVLSAHEGGKIQMKSKMPIRSLAELGRVYTPGVADVCRLIEKEPEKASIYTTISNSVAIVTDGTAILGLGNIGSVAGMPVMEGKAALFDQLAGISGIPILLDTSDPEEIIKTVKHISPGFSGILLEDIGSPHCFEIEDRLKEELNIPVMHDDQHGTAVVTLAAAISACRSAGVDLKEAKVGQIGLGAAGVAICRMFMAYGVNAVYGTDKSESAMNRLEQYGGQAVSSIEELMETCDIVIATTGVPGLIKPAFVRSGQVILALSNPKPEIEPEAALQAGAAYAADGRSVNNVLGFPGIFRGALNAKSTEINHDMLVAAAEAIAACTKQGDVVPQPLDSKVHHAVAAAVEHAALTAVK

SEQ ID NO: 29134 - protein, 513 aa, Bacillus subtilis
  strain 168
MSEKLDLTRFEKKMVIRNIEEKDIDKIIDLQKDCFPGMEPWKREHLISHLEHFPEGQFCAEFEGEIIGSCSSLLINFDEYDDRHTWQDITDDGYITNHNPDGLNMYGIEVMVHPKYRRMKIGHRLYEARKDLARRLNLKSIIIGGRIPNYHKYAEEMTAREYVEQVTRHQIYDPVLSFQLMNGFTLMRINPNYLPDDTASIKYATLMEWNNVDYLPQQTKRYYKSAFPVRICVIQYEMKKIYSFEEFANQVEYYVDVASDARSDFAVFPEIFTTQLMSFLEERSPSLAVQRITEYTEDYISLFTDLAVKYNVNIIGGSHFVEEEGKIYNIAYLFRRDGTIEKQYKLHITPNERKWWGISAGDQVRVFDTDCGKIAIQICYDIEFPELARIAADKGAKIIFTPFCTEDRQGYLRVRYCSQARAVENQIYTVISGTVGNLPQTENMDIQYAQSGIFAPSDFEFARDGIVGETNPNIEMVVIGDVDLEILRRQRQNGTVRQLKDRRRDIYHIQYKK

SEQ ID NO: 29135 - protein, 258 aa, Bacillus subtilis
  strain 168
MNFSLEGRNIVVMGVANKRSIAWGIARSLHEAGARLIFTYAGERLEKSVHELAGTLDRNDSIILPCDVTNDAEIETCFASIKEQVGVIHGIAHCIAFANKEELVGEYLNTNRDGFLLAHNISSYSLTAVVKAARPMMTEGGSIVTLTYLGGELVMPNYNVMGVAKASLDASVKYLAADLGKENIRVNSISAGPIRTLSAKGISDFNSILKDIEERAPLRRTTTPEEVGDTAAFLFSDMSRGITGENLHVDSGFHITAR

SEQ ID NO: 29136 - protein, 449 aa, Bacillus subtilis
  strain 168
MKKKSFSIVIAGGGSTFTPGIVLMLLDHLEEFPIRKLKLYDNDKERQDRIAGACDVFIREKAPDIEFAATTDPEEAFTDVDFVMAHIRVGKYAMRALDEQIPLKYGVVGQETCGPGGIAYGMRSIGGVLEILDYMEKYSPDAWMLNYSNPAAIVAEATRRLRPNSKILNICDMPVGIEDRMAQILGLSSRKEMKVRYYGLNHFGWWTSIQDQEGNDLMPKLKEHVSQYGYIPKTEAEAVEASWNDTFAKARDVQAADPDTLPNTYLQYYLFPDDMVKKSNPNHTRANEVMEGREAFIFSQCDMITREQSSENSEIKIDDHASYIVDLARAIAYNTGERMLLIVENNGAIANFDPTAMVEVPCIVGSNGPEPITVGTIPQFQKGLMEQQVSVEKLTVEAWAEKSFQKLWQALILSKTVPNARVARLILEDLVEANKDFWPELDQSPTRIS

SEQ ID NO: 29137 - protein, 410 aa, Bacillus subtilis
  strain 168
MKEEIIERFTTYVKVDTQSDESVDTCPSTPGQLTLGNMLVDELKSIGMQDAAIDENGYVMATLPSNTEKDVPTIGFLAHVDTATDFTGKNVNPQIIESYDGKDIVLNEQLQVTLSPDQFPELSGYKGHTLITTDGTTLLGADNKAGIAEIMTAMDYLIKHPEIKHGTIRVAFTPDEEIGRGPHKFDVKRFNASFAYTVDGGPLGELEYESFNAAAAKITIKGNNVHPGTAKGKMINSAKIAMKLNSLLPADEAPEYTEGYEGFYHLLSIQGDVEETKLHYIIRDFDKENFQNRKETMKRAVEELQNEYGQDRILLDMNDQYYNMREKIEPVIEIVNIAKQAMENLGIEPKISPIRGGTDGSQLSYMGLPTPNIFTGGENFHGKFEYISVDNMVKAVNVIVEIAKQFEAQA

SEQ ID NO: 29138 - protein, 339 aa, Bacillus subtilis
  strain 168
MAILVTGGAGYIGSHTCVELLNSGYEIVVLDNLSNSSAEALNRVKEITGKDLTFYEADLLDREAVDSVFAENEIEAVIHFAGLKAVGESVAIPLKYYHNNLTGTFILCEAMEKYGVKKIVFSSSATVYGVPETSPITEDFPLGATNPYGQTKLMLEQILRDLHTADNEWSVALLRYFNPFGAHPSGRIGEDPNGIPNNLMPYVAQVAVGKLEQLSVFGNDYPTKDGTGVRDYIHVVDLAEGHVKALEKVLNSTGADAYNLGTGTGYSVLEMVKAFEKVSGKEVPYRFADRRPGDIATCFADPAKAKRELGWEAKRGLEEMCADSWRWQSSNVNGYKSAE

SEQ ID NO: 29139 - protein, 173 aa, Bacillus subtilis
  strain 168
MISKDQLVNEGIRAREVRLIGQNGDQLGIKSRQEALEIAGRANLDLVLVAANAKPPVCRIMDYGKFRFEQQKKEKEARKNQKIINLKEVRLSPTIDEHDFNTKLRNAIKFLEKGDKVKASIRFKGRAITHKEIGQRVLDRFSEACAEVATVETKPKMDGRSMFLMLAPKNEKQ

SEQ ID NO: 29140 - protein, 145 aa, Bacillus subtilis
  strain 168
MRTTPMANASTIERKWLVVDAAGKTLGRLSSEVAAILRGKHKPTYTPHVDTGDHVIIINAEKIELTGKKLTDKIYYRHTQHPGGLKSRTALEMRTNYPEKMLELAIKGMLPKGSLGRQMFKKLNVYRGSEHPHEAQKPEVYELRG

SEQ ID NO: 29141 - protein, 276 aa, Bacillus subtilis
  strain 168
MSELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 29142 - protein, 290 aa, Bacillus subtilis
  strain 168
MRFDEAYSGKVFIASRPEWEEADAILYGMPMDWTVSYRPGSRFGPSRIREVSIGLEEYSPYLDRDLADLNFFDAGDIPLPFGNPQRSLDMIEEYVDSILEKGKFPMGMGGEHLVSWPVIKAMYKKYPDLAIIHFDAHTDLRVDYEGEPLSHSTPIRKAAELIGPHNVYSFGIRSGMKEEFEWAKENGMHISKFEVLEPLKEVLPKLAGRPVYVTIDIDVLDPAHAPGTGTVDAGGITSKELLASVHEIARSEVNVKGADLVEVAPVYDHSEQTANTASKIIREMLLGFVK

SEQ ID NO: 29143 - protein, 490 aa, Bacillus subtilis
  strain 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 29144 - protein, 402 aa, Bacillus subtilis
  strain 168
MTLNMKVESMQKFHTFEIPTVIKHGIGAIKHTGEEVAALGVSKALLVTDPGIYKAGVADPVIESLKEAGIEVVLFNKVEPNPPVRLVNEGSELYKKENCNGLVAVGGGSSMDTAKAIGVEATHEGSVLDYEAADGKKPLENRIPPLTTIPTTAGTGSEVTQWAVITDEEREFKFNTGGPLIAAHLTIIDPELHVSMPPHVTAMTGIDALAHAIECYTMKFAQPITDAVALMAIEYAAHYIKRAFADGEDLEARYGMAQAAMLAGLSYGSESAGAAHAMSQTLGGIIPVAHGQCVAAMMGPVMEYNWKGYPEKFARIAKAFGIDTSKMTTEEAAKASVNWMYDLVEDLEVPTLEEQGVSPDMIERLSKEAMKDPQTFGNPRDLNEKAYNWIYKRCFNLTPKTV

SEQ ID NO: 29145 - protein, 317 aa, Bacillus subtilis
  strain 168
MSKIAFLFPGQGSQFIGMGKELYEQVPAAKRLFDEADETLETKLSSLIFEGDAEELTLTYNAQPALLTTSIAVLEKFKESGITPDFTAGHSLGEYSALVAAGALSFKDAVYTVRKRGEFMNEAVPAGEGAMAAILGMDAEALKQVTDKVTEEGNLVQLANLNCPGQIVISGTAKGVELASELAKENGAKRAIPLEVSGPFHSELMKPAAEKLKEVLDACDIKDADVPVISNVSADVMTEKADIKEKLIEQLYSPVRFEESINKLIAEGVTTFIEIGPGKVLSGLVKKVNRRLKTIAVSDPETIELAIQTLKEENDNA

SEQ ID NO: 29146 - protein, 429 aa, Bacillus subtilis
  strain 168
MHTKSIELHNEALQHIVGGVNSPSRSYKAVGGGSPVAMEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGILKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 29147 - protein, 258 aa, Bacillus subtilis
  strain 168
MSFFKKLAASAGIGAAKVDTILEKDAYFPGEEVQGTVHVKGGKIAQDIRYIDLQLSTRYVIVKDDEEHRKYATIHSFRVTGSFTIQPGEEHQFPFTFTLPLDTPITVGKVEVAVVTDLDIQGGIDKSDHDRIFVEAHPWIENVLEAIENLGFRLNEADCEQAPYFQRRLPFVQEFEFVPTSGYYRQMLDELELIFLLDEDGLEIIFEVDRRARGLRGWLEEMYNDGEQLVRVRFSQSELEDTEELEEVLEEILDQYAE

SEQ ID NO: 29148 - protein, 187 aa, Bacillus subtilis
  strain 168
MSLIGKEVLPFEAKAFKNGEFIDVTNEDLKGQWSVFCFYPADFSFVCPTELEDLQEQYAALKELGVEVYSVSTDTHFVHKGWHDSSEKISKITYAMIGDPSQTISRNFDVLDEETGLADRGTFIIDPDGVIQTVEINAGGIGRDASNLVNKVKAAQYVRQNPGEVCPAKWEEGGETLTPSLDLVGKI

SEQ ID NO: 29149 - protein, 424 aa, Bacillus subtilis
  strain 168
MSVKWEKQEGNEGVLTVEVDAETFKTALDDAFKKVVKQVSIPGFRKGKIPRGLFEQRFGVEALYQDALDILLPVEYPKAVEEAGIEPVDRPEIDVEKIEKGESLIFTAKVTVKPEVKLGEYKGLGIEKDDTTVTDEDVQNELKALQERQAELVVKEEGAVEEGNTVVLDFEGFVDGEAFEGGKAENYSLEVGSGSFIPGFEDQLVGLEAGAEKDVEVTFPEEYHAEDLAGKPAVFKVKIHEIKAKELPELDDEFAKDIDEEVETLAELTEKTKKRLEEAKENEADAKLREELVLKASENAEIDVPQAMVDTELDRMLKEFEQRLQMQGMNLELYTQFSGQDEAALKEQMKEDAEKRVKSNLTLEAIAKAENLEVSDEEVDAELTKMAEAYNMPVENIKQAIGSTDAMKEDLKVRKAIDFLVENR

SEQ ID NO: 29150 - protein, 293 aa, Bacillus subtilis
  strain 168
MAITAQQVKELREKTGAGMMDCKKALTETDGDMDKAIDLLREKGIAKAAKKADRIAAEGSTLIKTDGNKGVILEVNSETDFVAKNEGFKELLNTLADHLLANTPADVEEAMGQKMENGSTVEEYITSAVAKIGEKITLRRFTVLTKDDSSAFGAYLHMGGRIGVLTVLNGTTDEETAKDIAMHVAAVNPRYISRDQVSEEETNHERQILTQQALQEGKPENIVAKMVEGRLNKFFEEICLLDQAFVKNPDEKVKQVIAAKNATVQTFVRYEVGEGIEKRQENFAEEVMNQVKK

SEQ ID NO: 29151 - protein, 469 aa, Bacillus subtilis
  strain 168
MSKQQIGVIGLAVMGKNLALNIESRGFSVSVYNRSSSKTEEFLQEAKGKNVVGTYSIEEFVQSLETPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 29152 - protein, 450 aa, Bacillus subtilis
  strain 168
MTHVRFDYSKALTFFNEHELTYLRDFVKTAHHNIHEKTGAGSDFLGWVDLPEHYDKEEFARIKKSAEKIKSDSDVLLVVGIGGSYLGARAAIEALNHAFYNTLPKAKRGNPQVIFIGNNISSSYMRDVMDLLEDVDFSINVISKSGTTTEPAIAFRIFRKLLEEKYGKEEAKARIYATTDKERGALKTLSNEEGFESFVIPDDVGGRYSVLTAVGLLPIAVSGVNIDDMMKGALDASKDFATSELEDNPAYQYAVVRNVLYNKGKTIEMLINYEPALQYFAEWWKQLFGESEGKDEKGIYPSSANYSTDLHSLGQYVQEGRRDLFETVLNVEKPKHELTIEEADNDLDGLNYLAGKTVDFVNKKAFQGTMLAHTDGNVPNLIVNIPELNAYTFGYLVYFFEKACAMSGYLLGVNPFDQPGVEAYKVNMFALLGKPGFEEKKAELEKRLED

SEQ ID NO: 29153 - protein, 359 aa, Bacillus subtilis
  strain 168
MERTTNFNAGPAALPLEVLQKAQKEFIDFNESGMSVMELSHRSKEYEAVHQKAKSLLIELMGIPEDYDILFLQGGASLQFSMLPMNFLTPEKTAHFVMTGAWSEKALAETKLFGNTSITATSETDNYSYIPEVDLTDVKDGAYLHITSNNTIFGTQWQEFPNSPIPLVADMSSDILSRKIDVSKFDVIYGGAQKNLGPSGVTVVIMKKSWLQNENANVPKILKYSTHVKADSLYNTPPTFAIYMLSLVLEWLKENGGVEAVEQRNEQKAQVLYSCIDESNGFYKGHARKDSRSRMNVTFTLRDDELTKTFVQKAKDAKMIGLGGHRSVGGCRASIYNAVSLEDCEKLAAFMKKFQQENE

SEQ ID NO: 29154 - protein, 167 aa, Bacillus subtilis
  strain 168
MAEITFKGGPVTLVGQEVKVGDQAPDFTVLTNSLEEKSLADMKGKVTIISVIPSIDTGVCDAQTRRFNEEAAKLGDVNVYTISADLPFAQARWCGANGIDKVETLSDHRDMSFGEAFGVYIKELRLLARSVFVLDENGKVVYAEYVSEATNHPNYEKPIEAAKALVK

SEQ ID NO: 29155 - protein, 300 aa, Bacillus subtilis
  strain 168
MSVFINKDTRVIVQGITGSTALFHTKQMLEYGTNIVGGVTPGKGGTEAEGVPVFNTVAEAVQTTGANASVIYVPAPFAADAIMEAVDAELDLVICITEHIPVLDMVKVKRFMEGKKTRLIGPNCPGVITPEECKIGIMPGYIHKKGHVGVVSRSGTLTYEAVHQLSEAGVGQSTAVGIGGDPVNGTNFIDVLKAFNEDPDTHAVIMIGEIGGTAEEEAAEWVKANMTKPVVGFIGGKTAPPGKRMGHAGAIISGGKGTADEKIKTLNACGIEVAETPSVMGETLIKVLKEKNLFETCKTH

SEQ ID NO: 29156 - protein, 261 aa, Bacillus subtilis
  strain 168
MAASTLTIKDLHVEIEGKEILKGVNLEIKGGEFHAVMGPNGTGKSTLSAAIMGHPKYEVTKGSITLDGKDVLEMEVDERAQAGLFLAMQYPSEISGVTNADFLRSAINARREEGDEISLMKFIRKMDENMEFLEMDPEMAQRYLNEGFSGGEKKRNEILQLMMIEPKIAILDEIDSGLDIDALKVVSKGINKMRSENFGCLMITHYQRLLNYITPDVVHVMMQGRVVKSGGAELAQRLEAEGYDWIKQELGIEDETVGQEA

SEQ ID NO: 29157 - protein, 692 aa, Bacillus subtilis
  strain 168
MAREFSLEKTRNIGIMAHIDAGKTTTTERILFYTGRIHKIGETHEGASQMDWMEQEQERGITITSAATTAQWKGYRVNIIDTPGHVDFTVEVERSLRVLDGAVAVLDAQSGVEPQTETVWRQATTYGVPRIVFVNKMDKIGADFLYSVGTLRDRLQANAHAIQLPIGAEDNFEGIIDLVENVAYFYEDDLGTRSDAKEIPEEYKEQAEELRNSLIEAVCELDEELMDKYLEGEEITIDELKAGIRKGTLNVEFYPVLVGSAFKNKGVQLVLDAVLDYLPAPTDVAAIKGTRPDTNEEIERHSSDEEPFSALAFKVMTDPYVGKLTFFRVYSGTLDSGSYVKNSTKGKRERVGRILQMHANSREEISTVYAGDIAAAVGLKDTTTGDTLCDEKDLVILESMEFPEPVIDVAIEPKSKADQDKMGIALAKLAEEDPTFRTQTNPETGQTIISGMGELHLDIIVDRMKREFKVEANVGAPQVAYRETFRTGAKVEGKFVRQSGGRGQFGHVWIEFEPNEEGAGFEFENAIVGGVVPREYIPAVQAGLEDALENGVLAGFPLIDIKAKLFDGSYHDVDSNEMAFKVAASMALKNAVSKCNPVLLEPIMKVEVVIPEEYMGDIMGDITSRRGRVEGMEARGNAQVVRAMVPLAEMFGYATALRSNTQGRGTFTMHMDHYEEVPKSVAEEIIKKNKGE

SEQ ID NO: 29158 - protein, 175 aa, Bacillus subtilis
  strain 168
MKILVLAVHPHMETSVVNKAWAEELSKHDNITVRDLYKEYPDEAIDVAKEQQLCEEYDRIVFQFPLYWYSSPPLLKKWQDLVLTYGWAFGSEGNALHGKELMLAVSTGSEAEKYQAGGANHYSISELLKPFQATSNLIGMKYLPPYVFYGVNYAAAEDISHSAKRLAEYIQQPFV

SEQ ID NO: 29159 - protein, 193 aa, Bacillus subtilis
  strain 168
MTISLAKGQKVDLTKTNPGLSKVVVGLGWDTNKYDGGHDFDLDSSVFLLDAAGKCASPNDFIFYNQLEGGNGSVVHSGDNLTGAGEGDDENVKVNLSAVPANIDKISFVITIHDAEARSQNFGQVSNAFVRIVNEETNEELIRYDLAEDFSIETAIIAGELYRHNGEWKFSAIGSGYQGGLARIATDYGLQVG

SEQ ID NO: 29160 - protein, 762 aa, Bacillus subtilis
  strain 168
MTTIKTSNLGFPRIGLNREWKKALEAYWKGSTDKDTFLKQIDELFLSAVKTQIDQQIDVVPVSDFTQYDHVLDTAVSFNWIPKRFRHLTDATDTYFAIARGIKDAVSSEMTKWFNTNYHYIVPEYDESIEFRLTRNKQLEDYRRIKQEYGVETKPVIVGPYTFVTLAKGYEPSEAKAIQKRLVPLYVQLLKELEEEGVKWVQIDEPALVTASSEDVRGAKELFESITSELSSLNVLLQTYFDSVDAYEELISYPVQGIGLDFVHDKGRNLEQLKTHGFPTDKVLAAGVIDGRNIWKADLEERLDAVLDILSIAKVDELWIQPSSSLLHVPVAKHPDEHLEKDLLNGLSYAKEKLAELTALKEGLVSGKAAISEEIQQAKADIQALKQFATGANSEQKKELEQLTDKDFKRPIPFEERLALQNESLGLPLLPTTTIGSFPQSAEVRSARQKWRKAEWSDEQYQNFINAETKRWIDIQEELELDVLVHGEFERTDMVEYFGEKLAGFAFTKYAWVQSYGSRCVRPPVIYGDVEFIEPMTVKDTVYAQSLTSKHVKGMLTGPVTILNWSFPRNDISRKEIAFQIGLALRKEVKALEDAGIQIIQVDEPALREGLPLKTRDWDEYLTWAAEAFRLTTSSVKNETQIHTHMCYSNFEDIVDTINDLDADVITIEHSRSHGGFLDYLKNHPYLKGLGLGVYDIHSPRVPSTEEMYNIIVDALAVCPTDRFWVNPDCGLKTRQQEETVAALKNMVEAAKQARAQQTQLV

SEQ ID NO: 29161 - protein, 145 aa, Bacillus subtilis
  strain 168
MSEQLIQAVNKQVANWTVMYVKLHNYHWYVKGKDFFTLHEKFEELYNETATYIDDLAERLLALNGKPIATMKESLETASVKEAAGNETAEQMVQSVYDDFTVIAEELKNGMDLADEVGDETTGDMLLAIHQNIEKHNWMLKAYLG

SEQ ID NO: 29162 - protein, 316 aa, Bacillus subtilis
  strain 168
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHRRDKLRAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 29163 - protein, 585 aa, Bacillus subtilis
  strain 168
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 29164 - protein, 385 aa, Bacillus subtilis
  strain 168
MNIHEYQGKEVLRKYGVSVPEGKVAFTAEEAVESAKSLSSSVYVVKAQIHAGGRGKAGGVKIAKSLDEVKAYAEELLGKTLVTHQTGPDGQVIKRLLIEEGCDIKKEYYIGLVLDRATSRIVLMASEEGGTEIEEVAEKTPEKIKKAVIDPAVGLQGYQAREIAFAINIPKELVGKAAKFMLGLYKAFVEKDCSIAEINPLVVTGDGNVMALDAKLNFDSNALYRQKDIMEYRDLDEEDPKEIEASKYDLSYISLDGNIGCMVNGAGLAMSTMDIIKHYGGEPANFLDVGGGATAEKVTEAFKIILSDQNVKGIFVNIFGGIMKCDVIAEGVVEATRQVGLTLPLVVRLEGTNVDLGKKILSESGLNITSAESMADGAQKIVSLV

SEQ ID NO: 29165 - protein, 199 aa, Bacillus subtilis
  strain 168
MAISLEKGQRIDLTKGKAGLSKLMVGLGWDPVSSGGGFFSKLLGGGGPNIDCDASVLMLENGKFTDKKNLIYFGNLKSRCGGVQHTGDNLTGDGAGDDEQIMIDLDKVPGNIDKLVFVVNIYDCVRRKQDFGMIQNAFIRVVDQSNHEEMLKYNLRDNYAGRTSLITAEIYRSGSEWKFAAVGEGTNDTRLEDIISRYV

SEQ ID NO: 29166 - protein, 202 aa, Bacillus subtilis
  strain 168
MTNTLDVLKARASVKEYDTNAPISKEELTELLDLATKAPSAWNLQHWHFTVFHSDESKAELLPVAYNQKQIVESSAVVAILGDLKANENGEEVYAELASQGYITDEIKQTLLGQINGAYQSEQFARDSAFLNASLAAMQLMIAAKAKGYDTCAIGGFNKEQFQKQFDISERYVPVMLISIGKAVKPAHQSNRLPLSKVSTWL

SEQ ID NO: 29167 - protein, 318 aa, Bacillus subtilis
  strain 168
MQLFDLPLDQLQTYKPEKTAPKDFSEFWKLSLEELAKVQAEPDLQPVDYPADGVKVYRLTYKSFGNARITGWYAVPDKEGPHPAIVKYHGYNASYDGEIHEMVNWALHGYATFGMLVRGQQSSEDTSISPHGHALGWMTKGILDKDTYYYRGVYLDAVRALEVISSFDEVDETRIGVTGGSQGGGLTIAAAALSDIPKAAVADYPYLSNFERAIDVALEQPYLEINSFFRRNGSPETEVQAMKTLSYFDIMNLADRVKVPVLMSIGLIDKVTPPSTVFAAYNHLETKKELKVYRYFGHEYIPAFQTEKLAFFKQHLKG

SEQ ID NO: 29168 - protein, 515 aa, Bacillus subtilis
  strain 168
MTTPYKHEPFTNFQDQNNVEAFKKALATVSEYLGKDYPLVINGERVETEAKIVSINPADKEEVVGRVSKASQEHAEQAIQAAAKAFEEWRYTSPEERAAVLFRAAAKVRRRKHEFSALLVKEAGKPWNEADADTAEAIDFMEYYARQMIELAKGKPVNSREGEKNQYVYTPTGVTVVIPPWNFLFAIMAGTTVAPIVTGNTVVLKPASATPVIAAKFVEVLEESGLPKGVVNFVPGSGAEVGDYLVDHPKTSLITFTGSREVGTRIFERAAKVQPGQQHLKRVIAEMGGKDTVVVDEDADIELAAQSIFTSAFGFAGQKCSAGSRAVVHEKVYDQVLERVIEITESKVTAKPDSADVYMGPVIDQGSYDKIMSYIEIGKQEGRLVSGGTGDDSKGYFIKPTIFADLDPKARLMQEEIFGPVVAFCKVSDFDEALEVANNTEYGLTGAVITNNRKHIERAKQEFHVGNLYFNRNCTGAIVGYHPFGGFKMSGTDSKAGGPDYLALHMQAKTISEMF

SEQ ID NO: 29169 - protein, 249 aa, Bacillus subtilis
  strain 168
MNEVIKSLTDHRSIRSYTDEPVAQEQLDQIIEAVQSAPSSINGQQVTVITVQDKERKKKISELAGGQPWIDQAPVFLLFCADFNRAKIALEDLHDFKMEITNGLESVLVGAVDAGIALGTATAAAESLGLGTVPIGAVRGNPQELIELLELPKYVFPLSGLVIGHPADRSAKKPRLPQEAVNHQETYLNQDELTSHIQAYDEQMSEYMNKRTNGKETRNWSQSIASYYERLYYPHIREMLEKQGFKVEK

SEQ ID NO: 29170 - protein, 436 aa, Bacillus subtilis
  strain 168
MSQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 29171 - protein, 462 aa, Bacillus subtilis
  strain 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 29172 - protein, 361 aa, Bacillus subtilis
  strain 168
MAKLDETLTMLKDLTDAKGIPGNEREVRQVMKSYIEPFADEVTTDRLGSLIAKKTGAENGPKIMIAGHLDEVGFMVTQITDKGFIRFQTVGGWWAQVMLAQRVTIVTKKGEITGVIGSKPPHILSPEARKKSVEIKDMFIDIGASSREEALEWGVLPGDMIVPHFEFTVMNNEKFLLAKAWDNRIGCAIAIDVLRNLQNTDHPNIVYGVGTVQEEVGLRGAKTAAHTIQPDIAFGVDVGIAGDTPGISEKEAQSKMGKGPQIIVYDASMVSHKGLRDAVVATAEEAGIPYQFDAIAGGGTDSGAIHLTANGVPALSITIATRYIHTHAAMLHRDDYENAVKLITEVIKKLDRKTVDEITYQ

SEQ ID NO: 29173 - protein, 141 aa, Bacillus subtilis
  strain 168
MLDTQQIKEIIPHRYPFLLVDRITEVEEGKRAKGYKNVTANEEFFNGHFPQYPVMPGVLIVEALAQVGAVAMLIKEENRGRLAFFAGIDNCRFKKQVKPGDQLHLEVEIIRARGTIGRGKGVATVDGEVVCEVELTFALGE

SEQ ID NO: 29174 - protein, 391 aa, Bacillus subtilis
  strain 168
MAERVRVRVRKKKKSKRRKILKRIMLLFALALLVVVGLGGYKLYKTINAADESYDALSRGNKSNLRNEVVDMKKKPFSILFMGIEDYATKGQKGRSDSLIVVTLDPKNKTMKMLSIPRDTRVQLAGDTTGSKTKINAAYSKGGKDETVETVENFLQIPIDKYVTVDFDGFKDVINEVGGIDVDVPFDFDEKSDVDESKRIYFKKGEMHLNGEEALAYARMRKQDKRGDFGRNDRQKQILNALIDRMSSASNIAKIDKIAEKASENVETNIRITEGLALQQIYSGFTSKKIDTLSITGSDLYLGPNNTYYFEPDATNLEKVRKTLQEHLDYTPDTSTGTSGTEDGTDSSSSSGSTGSTGTTTDGTTNGSSYSNDSSTSSNNSTTNSTTDSSY

SEQ ID NO: 29175 - protein, 298 aa, Bacillus subtilis
  strain 168
MRVTQGMIQQNSLRYIGSSYSKLDKLQSQISSGKKISKASDDPVVAMKSLKYNTQLSQVQQYKSNASQAFTWLENTETNITEGIDILSKVRELAVEAQNDTNGEPERQAIGVEVKQLKEQLLNIANTQVNGRYIFNGTNSDKPPVTDNGDGTYTISDTADVVVNISNNMSLKVNSDPKSAFGGTSESGQNVFEMLDSFEKALNSGSLDGMDSVLNDIDHFSDGMSAERSDLGARYNRLELVNTRLSAQEETATKVLSDNEDVELEEVITEFIAQQSVHRATLAVNAQIVQPTLIDFLK

SEQ ID NO: 29176 - protein, 183 aa, Bacillus subtilis
  strain 168
MFTCKVNEHITIRLLEPKDAERLAELIIQNQQRLGKWLFFAENPSSADTYRETIIPDWRRQYADLNGIEAGLLYDGSLCGMISLHNLDQVNRKAEIGYWIAKEFEGKGIITAACRKLITYAFEELELNRVAICAAVGNEKSRAVPERIGFLEEGKARDGLYVNGMHHDLVYYSLLKREWEGEK

SEQ ID NO: 29177 - protein, 381 aa, Bacillus subtilis
  strain 168
MSLFIQNDQQRQWMEKIGRIADEFQQTAAEDDEQGRFPAEKIQKLRDAGYTALTLPASHGGGGISVYDMLLFQERLARGDAPTALSIGWHLSVIGELGEGNSWDEDVFAFVAKEVQNGAVINRAATEAKTGSPTRGGRPGTHAVKKDGKWAVNGRKTFTTMSQALDYFLVTAWIEDKQTTGVFLIHKDDPGLSIEETWDMMAMRATGSHDLVLNEVMLDENKLVELLQGPRGAKPNGWLLHIPAIYLGVAQAARDYAVQFASEYSPNSLNGPIKNVPAVQQRTGEMELELLNARHFLFHIAQLYDDPVRRPHLTSELGAAKHIVTNAALSVVDKAMRIVGAKSLERTNPLQRYYRDVRAGLHNPPMDDAVIHKLAAEAFES

SEQ ID NO: 29178 - protein, 106 aa, Bacillus subtilis
  strain 168
MKKITTNEQFNELIQSDKEIIVKFYADWCPDCTRMNMFIGDILEEYNQNDWYELNKDELPDLAEKYQVMGIPSLLIFKNGEKTAHLHSANAKTPEEVTEFLSEHIS

SEQ ID NO: 29179 - protein, 457 aa, Bacillus subtilis
  strain 168
MIKRTVKNIAEMVKGTLANPQYEQTVIHGVATDTRKLEQHQLFIPLKGERFDGHSFVEQAFEAGVAAVLWDRSVPNPPENHAVILVDDTLTALQQLAKAYLQELGTRVIGVTGSNGKTTTKDMIHAVLGTQYRVHKTGGNFNNHIGLPLTVLAMPENTEIAVLEMGMSAKGEIDLLSRLANPDAAVITNIGESHMQDLGSREGIAEAKLEIINGLKEDGVLIYIGDEPLLQNAYSCQTKTYGTGTHNDYQLQDVSQSEEGTHFTIKGIENTFFIPILGKHNVMNAMAAIAAGAYFGIAPEDAAKGLSGLKVTGMRLELIKTDSGLSIINDAYNASPTSMKAAIQLTESLEGYGKKMLVLGDMLELGDLEETFHKECGAVISPDKIDRVFTYGKLGAFIAEGALKHFEKDRVSHYTEKKDLLQAVKENASKGDLILFKASRGMKLEEIVKDLIESPLS

SEQ ID NO: 29180 - protein, 451 aa, Bacillus subtilis
  strain 168
MENDQFLQKQHFLILGLAKSGYAAASILHEKGIYVAVNDQKPFEENEPAQKLSEKGIEVVCGEHPVSLFDQHQITILIKNPGIPYENIMVQEAEKRGIPVWTEIELAYYLTSAKFIGITGSNGKTTTTTLIYEMLKADSQKALIAGNIGTVASEVAYHADGDEWIVTELSSFQLMGTHAFRPEISLILNVFDAHLDYHHTRENYEKAKQKVYLHQTASDKAIVNQDDETVVRLAEAGKAEIVPFSVSKTLEQGAYVKDSMIMFNGEAILPLEEVVLPGAHNLENILAAIAVVKTAGASNEAVKKVLTSFTGVKHRLQYVTTVNGRKFYNDSKATNILATSKALSAFDKPVILLAGGLDRGNGFDDLKPYMKHVKAVLTFGQTAPKLEKLGNELGIQHVKRVDNVEQAVSAAFALSNEGDVILLSPACASWDQFKTFEERGDMFIDAVHMLK

SEQ ID NO: 29181 - protein, 3583 aa, Bacillus subtilis
  strain 168
MSKKSIQKVYALTPMQEGMLYHAMLDPHSSSYFTQLELGIHGAFDLEIFEKSVNELIRSYDILRTVFVHQQLQKPRQVVLAERKTKVHYEDISHADENRQKEHIERYKQDVQRQGFNLAKDILFKVAVFRLAADQLYLVWSNHHIMMDGWSMGVLMKSLFQNYEALRAGRTPANGQGKPYSDYIKWLGKQDNEEAESYWSERLAGFEQPSVLPGRLPVKKDEYVNKEYSFTWDETLVARIQQTANLHQVTGPNLFQAVWGIVLSKYNFTDDVIFGTVVSGRPSEINGIETMAGLFINTIPVRVKVERDAAFADIFTAVQQHAVEAERYDYVPLYEIQKRSALDGNLLNHLVAFENYPLDQELENGSMEDRLGFSIKVESAFEQTSFDFNLIVYPGKTWTVKIKYNGAAFDSAFIERTAEHLTRMMEAAVDQPAAFVREYGLVGDEEQRQIVEVFNSTKAELPEGMAVHQVFEEQAKRTPASTAVVYEGTKLTYRELNAAANRLARKLVEHGLQKGETAAIMNDRSVETVVGMLAVLKAGAAYVPLDPALPGDRLRFMAEDSSVRMVLIGNSYTGQAHQLQVPVLTLDIGFEESEAADNLNLPSAPSDLAYIMYTSGSTGKPKGVMIEHKSILRLVKNAGYVPVTEEDRMAQTGAVSFDAGTFEVFGALLNGAALYPVKKETLLDAKQFAAFLREQSITTMWLTSPLFNQLAAKDAGMFGTLRHLIIGGDALVPHIVSKVKQASPSLSLWNGYGPTENTTFSTSFLIDREYGGSIPIGKPIGNSTAYIMDEQQCLQPIGAPGELCVGGIGVARGYVNLPELTEKQFLEDPFRPGERIYRTGDLARWLPDGNIEFLGRIDNQVKVRGFRIELGEIETKLNMAEHVTEAAVIIRKNKADENEICAYFTADREVAVSELRKTLSQSLPDYMVPAHLIQMDSLPLTPNGKINKKELPAPQSEAVQPEYAAPKTESEKKLAEIWEGILGVKAGVTDNFFMIGGHSLKAMMMTAKIQEHFHKEVPIKVLFEKPTIQELALYLEENESKEEQTFEPIRQASYQQHYPVSPAQRRMYILNQLGQANTSYNVPAVLLLEGEVDKDRLENAIQQLINRHEILRTSFDMIDGEVVQTVHKNISFQLEAAKGREEDAEEIIKAFVQPFELNRAPLVRSKLVQLEEKRHLLLIDMHHIITDGSSTGILIGDLAKIYQGADLELPQIHYKDYAVWHKEQTNYQKDEEYWLDVFKGELPILDLPADFERPAERSFAGERVMFGLDKQITAQIKSLMAETDTTMYMFLLAAFNVLLSKYASQDDIIVGSPTAGRTHPDLQGVPGMFVNTVALRTAPAGDKTFAQFLEEVKTASLQAFEHQSYPLEELIEKLPLTRDTSRSPLFSVMFNMQNMEIPSLRLGDLKISSYSMLHHVAKFDLSLEAVEREEDIGLSFDYATALFKDETIRRWSRHFVNIIKAAAANPNVRLSDVDLLSSAETAALLEERHMTQITEATFAALFEKQAQQTPDHSAVKAGGNLLTYRELDEQANQLAHHLRAQGAGNEDIVAIVMDRSAEVMVSILGVMKAGAAFLPIDPDTPEERIRYSLEDSGAKFAVVNERNMTAIGQYEGIIVSLDDGKWRNESKERPSSISGSRNLAYVIYTSGTTGKPKGVQIEHRNLTNYVSWFSEEAGLTENDKTVLLSSYAFDLGYTSMFPVLLGGGELHIVQKETYTAPDEIAHYIKEHGITYIKLTPSLFHTIVNTASFAKDANFESLRLIVLGGEKIIPTDVIAFRKMYGHTEFINHYGPTEATIGAIAGRVDLYEPDAFAKRPTIGRPIANAGALVLNEALKLVPPGASGQLYITGQGLARGYLNRPQLTAERFVENPYSPGSLMYKTGDVVRRLSDGTLAFIGRADDQVKIRGYRIEPKEIETVMLSLSGIQEAVVLAVSEGGLQELCAYYTSDQDIEKAELRYQLSLTLPSHMIPAFFVQVDAIPLTANGKTDRNALPKPNAAQSGGKALAAPETALEESLCRIWQKTLGIEAIGIDDNFFDLGGHSLKGMMLIANIQAELEKSVPLKALFEQPTVRQLAAYMEASAVSGGHQVLKPADKQDMYPLSSAQKRMYVLNQLDRQTISYNMPSVLLMEGELDISRLRDSLNQLVNRHESLRTSFMEANGEPVQRIIEKAEVDLHVFEAKEDEADQKIKEFIRPFDLNDAPLIRAALLRIEAKKHLLLLDMHHIIADGVSRGIFVKELALLYKGEQLPEPTLHYKDFAVWQNEAEQKERMKEHEAYWMSVLSGELPELDLPLDYARPPVQSFKGDTIRFRTGSETAKAVEKLLAETGTTLHMVLHAVFHVFLSKISGQRDIVIGSVTAGRTNADVQDMPGMFVNTLALRMEAKEQQTFAELLELAKQTNLSALEHQEYPFEDLVNQLDLPRDMSRNPLFNVMVTTENPDKEQLTLQNLSISPYEAHQGTSKFDLTLGGFTDENGIGLQLEYATDLFAKETAEKWSEYVLRLLKAVADNPNQPLSSLLLVTETEKQALLEAWKGKALPVPTDKTVHQLFEETVQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEGNPETAVTAENLAYMIYTSGTTGQPKGVMVEHHALVNLCFWHHDAFSMTAEDRSAKYAGFGFDASIWEMFPTWTIGAELHVIDEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWVNGGIEYIGRIDQQVKVRGYRIELSEIEVQLAQLSEVQDAAVTAVKDKGGNTAIAAYVTPETADIEALKSTLKETLPDYMIPAFWVTLNELPVTANGKVDRKALPEPDIEAGSGEYKAPTTDMEELLAGIWQDVLGMSEVGVTDNFFSLGGDSIKGIQMASRLNQHGWKLEMKDLFQHPTIEELTQYVERAEGKQADQGPVEGEVILTPIQRWFFEKNFTNKHHWNQSVMLHAKKGFDPERVEKTLQALIEHHDALRMVYREENGDIVQVYKPIGESKVSFEIVDLYGSDEEMLRSQIKLLANKLQSSLDLRNGPLLKAEQYRTEAGDHLLIAVHHLVVDGVSWRILLEDFASGYMQAEKEESLVFPQKTNSFKDWAEELAAFSQSAHLLQQAEYWSQIAAEQVSPLPKDCETEQRIVKDTSSVLCELTAEDTKHLLTDVHQPYGTEINDILLSALGLTMKEWTKGAKIGINLEGHGREDIIPNVNISRTVGWFTAQYPVVLDISDADASAVIKTVKENLRRIPDKGVGYGILRYFTETAETKGFTPEISFNYLGQFDSEVKTDFFEPSAFDMGRQVSGESEALYALSFSGMIRNGRFVLSCSYNEKEFERATVEEQMERFKENLLMLIRHCTEKEDKEFTPSDFSAEDLEMDEMGDIFDMLEENLK

SEQ ID NO: 29182 - protein, 290 aa, Bacillus subtilis
  strain 168
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 29183 - protein, 292 aa, Bacillus subtilis
  strain 168
MKKVRKAIIPAAGLGTRFLPATKAMPKEMLPIVDKPTIQYIIEEAVEAGIEDIIIVTGKSKRAIEDHFDYSPELERNLEEKGKTELLEKVKKASNLADIHYIRQKEPKGLGHAVWCARNFIGDEPFAVLLGDDIVQAETPGLRQLMDEYEKTLSSIIGVQQVPEEETHRYGIIDPLTSEGRRYQVKNFVEKPPKGTAPSNLAILGRYVFTPEIFMYLEEQQVGAGGEIQLTDAIQKLNEIQRVFAYDFEGKRYDVGEKLGFITTTLEFAMQDKELRDQLVPFMEGLLNKEEI

SEQ ID NO: 29184 - protein, 880 aa, Bacillus subtilis
  strain 168
METNEQTMPTKYDPAAVEKDRYDFWLKGKFFEAGSDQTKEPYSVVIPPPNVTGRLHLGHAWDTTLQDIVTRMKRMQGYDVLWLPGMDHAGIATQAKVEAKLREEGKSRYDLGREKFLEETWKWKEEYADFIRSQWAKLGLGLDYSRERFTLDEGLSKAVREVFVKLYEKGLIYRGEYIINWDPATKTALSDIEVIYKDVQGAFYHMSYPLADGSGSIEIATTRPETMLGDTAVAVHPEDERYKHLIGKTVILPIVNREIPIVGDDYVDMEFGSGAVKITPAHDPNDFELGNRHNLERILVMNEDGTMNENALQYQGMDRFECRKKLVKDLQEAGVLFKIEDHMHSVGHSERSGAVVEPYLSTQWFVRMQPLADAAIELQKKEEKVNFVPDRFEKTYLHWMENIRDWCISRQLWWGHRIPAWYHKETGELYVGLEAPEDSENWEQDTDVLDTWFSSALWPFSTMGWPDVTAEDFKRYYPTDVLVTGYDIIFFWVSRMIFQGIEFTGERPFKDVLIHGLIRDEQGRKMSKSLGNGVDPMDVIDKYGADSLRYFLATGSSPGQDLRFSYEKVESTWNFANKIWNASRFALMNMDGMTYDELDLSGEKSVADKWILTRLNETIEHVTQLADRYEFGEVGRHLYNFIWDDFCDWYIEMAKLPLYGEDEAAKKTTRSILAYVLDQTMRLLHPFMPFLTEEIWQHLPHQGESITVSQWPAVVPEHTDTEAAADMKLLVELIRSVRNIRSEVNTPMSKQVELYIKTSTDEIASRLEANRSYVERFTNPSVLKIGTDIEAVDKAMTAVVSGAEVILPLEGLINIDEEIARLQKEFDKLTKEVERVQKKLGNEGFMKKAPAHVIDEEREKEKDYVAKRDAVQKRMAELKG

SEQ ID NO: 29185 - protein, 353 aa, Bacillus subtilis
  strain 168
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 29186 - protein, 255 aa, Bacillus subtilis
  strain 168
MVKIFIDPGHGGSDPGATGNGLQEKTLTLQIALALRTILTNEYEGVSLLLSRTSDQYVSLNDRTNAANNWGADFFLSIHVNSGGGTGFESYIYPDVGAPTTTYQSTIHSEVIQAVDFADRGKKTANFHVLRESAMPALLTENGFIDTVSDANKLKTSSFIQSLARGHANGLEQAFNLKKTSSSGLYKVQIGAFKVKANADSLASNAEAKGFDSIVLLKDGLYKVQIGAFSSKDNADTLAARAKNAGFDAIVILES

SEQ ID NO: 29187 - protein, 466 aa, Bacillus subtilis
  strain 168
MTITLYNTLTRQKETFVPLEEGKVKMYVCGPTVYNYIHIGNARPAIVYDTVRNYLEYKGYDVQYVSNFTDVDDKLIKAANELGEDVPTISERFIKAYFEDVGALGCRKADLHPRVMENMDAIIEFVDQLVKKGYAYESEGDVYFKTRAFEGYGKLSQQSIDELRSGARIRVGEKKEDALDFALWKAAKEGEISWDSPWGKGRPGWHIECSAMVKKYLGDQIDIHAGGQDLTFPHHENEIAQSEALTGKTFAKYWLHNGYINIDNEKMSKSLGNFVLVHDIIKQHDPQLLRFFMLSVHYRHPINYSEELLENTKSAFSRLKTAYSNLQHRLNSSTNLTEDDDQWLEKVEEHRKAFEEEMDDDFNTANAISVLFDLAKHANYYLQKDHTADHVITAFIEMFDRIVSVLGFSLGEQELLDQEIEDLIEKRNEARRNRDFALSDQIRDQLKSMNIILEDTAQGTRWKRGE

SEQ ID NO: 29188 - protein, 141 aa, Bacillus subtilis; identical to SEQ ID NO: 653
  strain 168

SEQ ID NO: 29189 - protein, 232 aa, Bacillus subtilis
  strain 168
MAKKGKKYVEAAKLVDRSKAYDVSEAVALVKKTNTAKFDATVEVAFRLGVDPRKNDQQIRGAVVLPNGTGKTQRVLVFAKGEKAKEAEAAGADFVGDTDYINKIQQGWFDFDVIVATPDMMGEVGKIGRVLGPKGLMPNPKTGTVTFEVEKAIGEIKAGKVEYRVDKAGNIHVPIGKVSFEDEKLVENFTTMYDTILKAKPAAAKGVYVKNVAVTSTMGPGVKVDSSTFNVK

SEQ ID NO: 29190 - protein, 716 aa, Bacillus subtilis
  strain 168
MIQMPKKNKFMNRGAAILSICFALFFFVILGRMAYIQITGKANGEVLATKATEQHEKKRTIEASRGSILDRKGKVIAEDTATYKLIAILDKKMTTDVKHPQHVVNKEKTAEALSKVINLDKADILDILNKDAKQVEFGSAGRDITYSQKQKIEKMKLPGISFLRDTKRYYPNGVFASNLIGYAEVDEETNEISGAMGLEKVLDKYLKERDGYVTYESDKSGWELPNSKNKITAPKNGDNVYLTIDQKIQTFLEDSMTKVAQKYNPKKIMAAVVDPKTGKVLAMGQRPSFDPNKRDVTNYYNDLISYAYEPGSTMKIFTLAAAMQENVFNANEKYKSGTFEVGGAPVKDHNNGVGWGPTTYHDGVLRSSNVAFAKLAKEKLGYDRLNQYLHKFNFYQKTGIDLPGEVSSKINFKYEFDKASTAYGQASAVTPIQQIQAATAIANDGKMMKPYVIDHIVDPDKDKTIYQNKPESAGTPISASTAKKVRDILGEVVTSKIGTGQAYKIEGFDVAGKTGTAQIAGKGGYLDGTDNYIFSFMGMAPKDDPELLIYVAVQQPQLKAGQSSSDPVSEIFNPTMKNSLHYLNIEPTEKSDSDKEETKAQTMPDLTDQTVAAAQKKAKEENLTPIVIGSDVAVKEQYPKADEEVLTNQKVFLKTGGKIKMPDMTGWSRREVLQYGELAGIHIEVSGQGYAVSQSVKKDKEIKDKTVIKVKFKNPD

SEQ ID NO: 29191 - protein, 378 aa, Bacillus subtilis
  strain 168
MIIGVPKEIKNNENRVALTPGGVSQLISNGHRVLVETGAGLGSGFENEAYESAGAEIIADPKQVWDAEMVMKVKEPLPEEYVYFRKGLVLFTYLHLAAEPELAQALKDKGVTAIAYETVSEGRTLPLLTPMSEVAGRMAAQIGAQFLEKPKGGKGILLAGVPGVSRGKVTIIGGGVVGTNAAKMAVGLGADVTIIDLNADRLRQLDDIFGHQIKTLISNPVNIADAVAEADLLICAVLIPGAKAPTLVTEEMVKQMKPGSVIVDVAIDQGGIVETVDHITTHDQPTYEKHGVVHYAVANMPGAVPRTSTIALTNVTVPYALQIANKGAVKALADNTALRAGLNTANGHVTYEAVARDLGYEYVPAEKALQDESSVAGA

SEQ ID NO: 29192 - protein, 242 aa, Bacillus subtilis
  strain 168
MSQLFKSFDASEKTQLICFPFAGGYSASFRPLHAFLQGECEMLAAEPPGHGTNQTSAIEDLEELTDLYKQELNLRPDRPFVLFGHSMGGMITFRLAQKLEREGIFPQAVIISAIQPPHIQRKKVSHLPDDQFLDHIIQLGGMPAELVENKEVMSFFLPSFRSDYRALEQFELYDLAQIQSPVHVFNGLDDKKCIRDAEGWKKWAKDITFHQFDGGHMFLLSQTEEVAERIFAILNQHPIIQP

SEQ ID NO: 29193 - protein, 135 aa, Bacillus subtilis
  strain 168
MQNPSKAEIKEILQRSKRIAVVGLSDRPDRTSHMVSKAMQDAGYEIIPVNPTIDEALGVKAVSSLKEIDGPIDIVNVFRRSEQLPGVAEEFLETDAPVFWAQQGLVNEEAYQMLKEKGRTVIMDLCIKVAHAVTK

SEQ ID NO: 29194 - protein, 806 aa, Bacillus subtilis
  strain 168
MSQPELFHDLPLEEVIGDRFGRYSKYIIQDRALPDARDGLKPVQRRILYAMHTDGNTFDKNFRKAAKTVGNVIGNYHPHGDSSVYEAMVRMSQDWKVRNVLIEMHGNNGSIDGDPPAAMRYTEARLSPIASELLRDIDKNTVEFVPNFDDTSKEPVVLPAMFPNLLVNGSTGISAGYATDIPPHHLGEVIDAVIKRIQMPSCSVDELMEVIKGPDFPTGGIIQGVDGIRKAYETGKGKIIIRGKAEIETIRGGREQIVITEIPFEVNKANLVKKMDEFRIDKKVEGISEVRDETDRTGLRVVIELKKEADAKGILNFLYKNTDLQITYNFNMVAIHNRRPMLMSLPSILDAYIGHQKEVVTNRSVYELQKAKDRHHIVEGLMKALSILDEVIATIRSSSDKRDAKNNLIAKYEFTEPQAEAIVSLQLYRLTNTDITALKEEAEELGKKIEELESILSNDKKLLKVITNSLKALKKKYADTRRSVIEEKIEEIKINLEVMVASEDVYVTVTKDGYLKRTSQRSFAASNGQDFGMKDTDRMLHQFEMNTTDVLLLFTNKGSYIYCPVHQLPDIRWKDMGQHFSNLITIDRDETIVKAIPIKEFDPSAYLLFFTKNGMVKKTELTHYKAQRYSKALVALNLKGEDELIDVHVTNGESQIFMATHLGYGLWFGEDEVNVVGARAAGVKGINLKEDDFVVSGEILQQSDSIVLFTQRGAVKRMSLSEFEKTSRAKRGVVMLRELKKNPHRVVALFACGLEQRLMAETEKGDRKELQTKELRTNDRYSNGSFFFDEEESGKVTAVWRLHTEQ

SEQ ID NO: 29195 - protein, 921 aa, Bacillus subtilis
  strain 168
MDFKDTLLMPKTDFPMRGNLPNREPDIQKKWEEEDIYRLVQERTKDRPKFVLHDGPPYANGDIHMGHALNKILKDFIVRYKSMSGYNAPYVPGWDTHGLPIETALTKNKKVNRKEMSVAEFRKLCEEYAWKQIEGQREQFKRLGVRGDWENPYVTLKPEYEAQQIRVFGEMAKRGYIYKGLKPVNWSPSSESALAEAEIEYQDKRSASIYVAFGVKDGKGVLENGERIIIWTTTPWTIPANLGISVHPDLEYSVIAVGEDRFVVASALVENVASACGFDQYEVTRTVKGKDLENIIAEHPLYGRDSLVMLGEHVTTDAGTGCVHTAPGHGEDDFIIGQKYGLDVLCPVDEKGVMTSEAPGFEGMFYDDANKAITQQLDEKGALVKLEFITHSYPHDWRTKKPTIFRATAQWFASIKDFRSDLLDAIKETKWVPEWGEQRLHNMVRDRGDWCISRQRAWGVPIPVFYAENGEPVITDETIEHVSELFRQHGSNIWFEKEAKDLLPEGFTHPGSPNGTFTKEQDIMDVWFDSGSSHQAVLEERDDLVRPADLYLEGSDQYRGWFNSSLSTAVAVTGKAPYKGVLSHGFALDGEGRKMSKSIGNVVVPAKVMKQLGADILRLWVSSVDYQADVRVSDAILKQVAEVYRKIRNTFRFLHGNLFDFDPKTNAVAVEDLREVDQYMLIKLNKLIDKVKKAYDEYEFAVVYHSIHNFCTIELSSFYLDFAKDIVYIEHADHPDRRSMQTVFYETLLALVKLSAPILPHTADELWSHLTFVEEQSVQLTDMPETITVPNSEATEEKFDRFMALRDDVLKALETARNEKIIGKSLEANLKLYPNKENKELLASIKENLSQLFIVSELTISEENEAPNDAQSFATGKIAVEKAEGEMCERSRVISKDVGANPKYPTLSLRNAEIVEKYYQK

SEQ ID NO: 29196 - protein, 555 aa, Bacillus subtilis
  strain 168
MKFVKNDQTAVFALGGLGEIGKNTYAVQFQDEIVLIDAGIKFPEDELLGIDYVIPDYTYLVKNEDKIKGLFITHGHEDHIGGIPYLLRQVNIPVYGGKLAIGLLRNKLEEHGLLRQTKLNIIGEDDIVKFRKTAVSFFRTTHSIPDSYGIVVKTPPGNIVHTGDFKFDFTPVGEPANLTKMAEIGKEGVLCLLSDSTNSENPEFTMSERRVGESIHDIFRKVDGRIIFATFASNIHRLQQVIEAAVQNGRKVAVFGRSMESAIEIGQTLGYINCPKNTFIEHNEINRMPANKVTILCTGSQGEPMAALSRIANGTHRQISINPGDTVVFSSSPIPGNTISVSRTINQLYRAGAEVIHGPLNDIHTSGHGGQEEQKLMLRLIKPKFFMPIHGEYRMQKMHVKLATDCGIPEENCFIMDNGEVLALKGDEASVAGKIPSGSVYIDGSGIGDIGNIVLRDRRILSEEGLVIVVVSIDMDDFKISAGPDLISRGFVYMRESGDLINDAQELISNHLQKVMERKTTQWSEIKNEITDTLAPFLYEKTKRRPMILPIIMEV

SEQ ID NO: 29197 - protein, 184 aa, Bacillus subtilis
  strain 168
MITMENIVRDGHPALRETAEPVELPPTDAEKQQLADMIEFVKNSQNPELAEKYKLRPGVGLAAPQINIKKRMIAVHAEDASGKLYSYALFNPKIVSHSVEKSYLTSGEGCLSVDEAIPGYVPRYARIRVKGTTLEGENIDIRLKGFPAIVFQHEIDHLNGVMFYDHIDKENPFKEPENAIAIER

SEQ ID NO: 29198 - protein, 57 aa, Bacillus subtilis
  strain 168
MPIKKKVMMCLAVTLVFGSMSFPTLTNSGGFKESTDRNTTYIDHSPYKLSDQKKALS

SEQ ID NO: 29199 - protein, 227 aa, Bacillus subtilis
  strain 168
MKVTYHGHSVITVETKDHHIIFDPFLTGNSLTDIKPEDVKADVILLTHGHNDHVGDTEQIAKQNNALVIAPNELAVYLGWKGLNVHPMHIGGSRQFDFGKVKLTQAFHGSAITDEENKTITYTGMPAGILLTVEDKTIFHAGDTALFSDMKLIGELNHIDLAFLPIGDNFTMGPEDAKLAAEWLRAKQVVPVHYNTFPVIEQDPEAFADSLPGGVGKVMSVGETIEL

SEQ ID NO: 29200 - protein, 1148 aa, Bacillus subtilis
  strain 168
MSQQSIQKVLVANRGEIAIRIFRACTELNIRTVAVYSKEDSGSYHRYKADEAYLVGEGKKPIDAYLDIEGIIDIAKRNKVDAIHPGYGFLSENIHFARRCEEEGIVFIGPKSEHLDMFGDKVKAREQAEKAGIPVIPGSDGPAETLEAVEQFGQANGYPIIIKASLGGGGRGMRIVRSESEVKEAYERAKSEAKAAFGNDEVYVEKLIENPKHIEVQVIGDKQGNVVHLFERDCSVQRRHQKVIEVAPSVSLSPELRDQICEAAVALAKNVNYINAGTVEFLVANNEFYFIEVNPRVQVEHTITEMITGVDIVQTQILVAQGHSLHSKKVNIPEQKDIFTIGYAIQSRVTTEDPQNDFMPDTGKIMAYRSGGGFGVRLDTGNSFQGAVITPYYDSLLVKLSTWALTFEQAAAKMVRNLQEFRIRGIKTNIPFLENVAKHEKFLTGQYDTSFIDTTPELFNFPKQKDRGTKMLTYIGNVTVNGFPGIGKKEKPAFDKPLGVKVDVDQQPARGTKQILDEKGAEGLANWVKEQKSVLLTDTTFRDAHQSLLATRIRSHDLKKIANPTAALWPELFSMEMWGGATFDVAYRFLKEDPWKRLEDLRKEVPNTLFQMLLRSSNAVGYTNYPDNVIKEFVKQSAQSGIDVFRIFDSLNWVKGMTLAIDAVRDTGKVAEAAICYTGDILDKNRTKYDLAYYTSMAKELEAAGAHILGIKDMAGLLKPQAAYELVSALKETIDIPVHLHTHDTSGNGIYMYAKAVEAGVDIIDVAVSSMAGLTSQPSASGFYHAMEGNDRRPEMNVQGVELLSQYWESVRKYYSEFESGMKSPHTEIYEHEMPGGQYSNLQQQAKGVGLGDRWNEVKEMYRRVNDMFGDIVKVTPSSKVVGDMALYMVQNNLTEKDVYEKGESLDFPDSVVELFKGNIGQPHGGFPEKLQKLILKGQEPITVRPGELLEPVSFEAIKQEFKEQHNLEISDQDAVAYALYPKVFTDYVKTTESYGDISVLDTPTFFYGMTLGEEIEVEIERGKTLIVKLISIGEPQPDATRVVYFELNGQPREVVIKDESIKSSVQERLKADRTNPSHIAASMPGTVIKVLAEAGTKVNKGDHLMINEAMKMETTVQAPFSGTIKQVHVKNGEPIQTGDLLLEIEKA

SEQ ID NO: 29201 - protein, 458 aa, Bacillus subtilis
  strain 168
MDYRRDGQNDQHQTEPSHTEQQNTENQKLIGHSEQELLDAPVSYEAGRQETASALEMEKQETAVKKEKKRRAAWLSPILGGIIGGGLMLGIAPYLPSDQNQATETASANKQVQSDNFTTAPITNASNIADMVEDLEPTIVGISNIQTSQNNTFGTGGGSSSESESGTGSGVIFKKDSDKAYIITNNHVVEGANKLTVTLYNGETETAKLVGSDTITDLAVLEISGKNVKKVASFGDSSQLRTGEKVIAIGNPLGQQFSGTVTQGIISGLNRTIDVDTTQGTVEMNVLQTDAAINPGNSGGPLINASGQVIGINSLKVSESGVESLGFAIPSNDVEPIVDQLLQNGKVDRPFLGVQMIDMSQVPETYQENTLGLFGDQLGKGVYVKEVQANSPAEKAGIKSEDVIVKLNGKDVESSADIRQILYKDLKVGDKTTIQVLRKGKTKTLNATLTKQTESSSS

SEQ ID NO: 29202 - protein, 354 aa, Bacillus subtilis QB928; identical to SEQ ID NO: 5052

SEQ ID NO: 29203 - protein, 236 aa, Bacillus subtilis QB928; identical to SEQ ID NO: 4290

SEQ ID NO: 29204 - protein, 213 aa, Bacillus subtilis QB928; identical to SEQ ID NO: 4201

SEQ ID NO: 29205 - protein, 1229 aa, Bacillus subtilis QB928
MPCIMQKPERNYMLSVEMISRQNRCHYVYKGGNMMRRILHIVLITALMFLNVMYTFEAVKAAEPQQPISIEKAIQQKEGQALVEGYAVGQAVSPQHYKLTSPFSNDYNVALADRKNKTSPEHILPVQIPSAFRSQFGLQTNPLLLGKKITVQGKLENYFNTTGLKNVQSMNVTDDTKTPPAEQQVTINEARGRLNEEVTIKGIITADQNAIGGGKLSTFLQDETGGINIYSPSPEQFPELKEGMDVTVTGKITSYQGLKEIVPNSSGIKINQSNQSLPAPKHLTINELINGSLGDQYEGRLVKLTAFVSSIPSSPAGGGYNVTMIDDDHHAMTLRVMNETGVINELDEGKWYEFTGVLSRYQTFQLLPRKSADLKLLEEQPAPPSAEGEYEGIVDRVVDGDTIHLKSPVLGTTKIRFVNVDAPETYHTPKNDADENQLRFGKKASDYLKTVLSPGDKITVKVGSEAKDSYGRLLGQVITESGSNVNLELVKNGYAPTYFIWPVDNEEDYQQFQAAVAAAKKDQKGIWNENDPLMEMPFEFRAREQGKGLTRYVGDSSNKTYVQPADWKKIAVENRIFFASASEAESAGYKKRQTAPQEHVPLRILSMNDLHGKIDQQYELDLDGNGTVDGTFGRMDYAAAYLKEKKAEKKNSLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGVPVAFIGVVTQSAAGMVMPEGIKNIEFTDEATAVNKAAEELKKKGVKAIAVLAHMSAEQNGNAITGESADLANKTDSEIDVIFAAHNHQVVNGEVNGKLIVQAFEYGKAIGVVDVEIDKTTKDIVKKSAEIVYVDQSKIEPDVSASAILKKYETIAEPIISEVVGEAAVDMEGGYSNDGDTPLGNLIADGMRAAMKTDFALMNGGGIREALKKGPITWGDLYNIQPFGNVLTKLEIKGKDLREIINAQISPVFGPDYSISGFTYTWDKETGKAVDMKMADGTEIQPDATYTLTVNNFMATATGAKYQPIGLLGKNPVTGPEDLEATVEYVKSFDEPIAYTKEGRIKLAEASDIEDPVTEDPITEEPGDDPGTEDPIKEDPRPGEDLPDIKETPGTAPVHQLPPSAISRFNEIPINNTKTADTANSISTLPLQTETAESGSDHQLPDTSAGYYNFMVIGAAVTLSGTYLYVRRKRSASRT

SEQ ID NO: 29206 - protein, 290 aa, Bacillus subtilis QB928
MSLYLQYLERGSEMKISMQKADFWKKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 29207 - protein, 237 aa, Bacillus subtilis QB928
MTKRNNIGIIVHMFRTFYYIGGNIMAGKLVPCKACGQEIAKGVKKCPNCGKDQRNFFMRHKIITFILAVVVIIIIGNMIGGGGGSEATSKTSSSSKAETEKTYNIGDTVKTEKTEVTVTKVEDRDTVGTQYVEKKASEGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 29208 - protein, 430 aa, Bacillus subtilis QB928; identical to SEQ ID NO: 5092

SEQ ID NO: 29209 - protein, 221 aa, Bacillus subtilis QB928; identical to SEQ ID NO: 4187

SEQ ID NO: 29210 - protein, 58 aa, Bacillus subtilis; identical to SEQ ID NO: 28867
  subsp. spizizenii

SEQ ID NO: 29211 - protein, 277 aa, Bacillus subtilis; identical to SEQ ID NO: 4175
  subsp. subtilis str. BSP1

SEQ ID NO: 29212 - protein, 236 aa, Bacillus subtilis
  subsp. subtilis str. BSP1
MRRILSIFVFAIMLAGCSSNASTEKQHAGGEKTVKAEPQSTSSQKDSTDNYQPNSQVTDDRSLLKVGQTFSDDKGKAVLKDIKQVNKTYKIGDVELTVKEMKLIHLRPDYSMIDYFHELTHDEEFDFVKVFVDIKNTSSKKVNVAPIALMKTNTGETFEWNKDIYLEELNGELEGGAEKSGNLGFIVNASSRHAHDKAADAEKKTKEIKWIEITTSDVFDHNHKKISDAQKIKIKF

SEQ ID NO: 29213 - protein, 354 aa, Bacillus subtilis
  subsp. subtilis str. BSP1
MFQKKTYAVFLILLLMMFTAACSGSKTSAEKKESETEKSSDIAQVKIKDVSYTLPSKYDKSTSDDQLVLKVNVAVKNTGKDPLNVDSMDFTLYQGDTKMSDTDPEDYSEKLQGSTINADKSVEGNLFFVVDKGKQYELNYTPESYGDKKPKSVTFKIDGKDKKILATADKLQDSAKALSAYVDVLLFGKDNANFEKITGANKNEIVNDFNESAKDGYLSASGLSSTYADSKALDNIVNGIKEGLSKNSSIQAKTTSISKDEAIVEATVKPVDASSLSDRIEDKVKDYYSKNSSASYEEAVKYALQVYPEEFKKLGPASSEKTVEVKMKKNDIDQWQLDMDDYRAAELVEAFIKE

SEQ ID NO: 29214 - protein, 213 aa, Bacillus subtilis
  subsp. subtilis str. BSP1
MAGKLVPCKACGQEIAKGVKKCPNCGKDQRNFFMRHKIITFILAVVVIIIIGNMIGGGGGSEATSKTSSGSKAETEKTYNIGDTVKTEKTEVTVTKVEDRDTVGTQYVEKKASDGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 29215 - protein, 221 aa, Bacillus subtilis; identical to SEQ ID NO: 5095
  subsp. subtilis str. BSP1

SEQ ID NO: 29216 - protein, 680 aa, Bacillus subtilis
  subsp. subtilis str. BSP1
MKILEVSTILETAETRLKAYQTLREHMATLKKQFKKMANLDDAMTGKGANAIKAFYKEQATGADLWLDLIDMRIAFFKNIPSAIEAATFDDDAYIEESYLDNELYNGLVKADGIIEAQQKEIKSILNSIDDILPLSLFDNSTVTDKLDKADKKRKKTITHLHNLDEKLNSDYEASEVVEHEVRAFFEALTGATSKGGSTNPISFNAKAFHETDVYQNKADIHKQAQQFIKAKKQEEIEYLKKKLDKTTDPDEYLKVAEKIGTDNLSAEQLQYYSSIVQMKAQQQTGKMLVEGGKGVIVGLWDAGKDIVTGACDLAVGAYDLAIWSYRAQGKMGIEEQVKAGQELQNIIYSAPETFEYMVDSFKKSWNDNMVHGDVYSRSHYITYAVASLFGAKGLGKVASATKAGKFVTKETKAFVNDHKSIAKNITEKAKPYFKLPSNNQLESAIQGVGNIESPIPKLEKGFDKKLENFVKINSSDHSKSGGVGPNENSKITRDIKTVEEAHQWGSKYYDDWIKSLTPGEQEAIKQYTGDDYKKINDYLRGISDSLDGIDLDTIYNIKNGLDKARVPHNLQVYRGTDLRPLESLIEINKYGDINAESLIGKIFRDNGFVSTAIVKESSFDHMEVSWEINVPAGTNAAYLGKISHFPNEAELLLNFGQEMVIKSAHVDSNNKLHIILDLI

SEQ ID NO: 29217 - protein, 103 aa, Bacillus subtilis
  subsp. subtilis str. SC-8
MPTVAGQLIKLDLAISVDVTTTANSNFTFQTRIYRNGVLVDTRSVQRNINAAITSRFPIATTYVDATTVTGTTSYEIRIIFTTVSNVSGSNALNLDINAIRFP

SEQ ID NO: 29218 - protein, 548 aa, Bacillus thermoproteolyticus
MKMKMKLASFGLAAGLAAQVFLPYNALASTEHVTWNQQFQTPQFISGDLLKVNGTSPEELVYQYVEKNENKFKFHENAKDTLQLKEKKNDNLGFTFMRFQQTYKGIPVFGAVVTSHVKDGTLTALSGTLIPNLDTKGSLKSGKKLSEKQARDIAEKDLVANVTKEVPEYEQGKDTEFVVYVNGDEASLAYVVNLNFLTPEPGNWLYIIDAVDGKILNKFNQLDAAKPGDVKSITGTSTVGVGRGVLGDQKNINTTYSTYYYLQDNTRGNGIFTYDAKYRTTLPGSLWADADNQFFASYDAPAVDAHYYAGVTYDYYKNVHNRLSYDGNNAAIRSSVHYSQGYNNAFWNGSQMVYGDGDGQTFIPLSGGIDVVAHELTHAVTDYTAGLIYQNESGAINEAISDIFGTLVEFYANKNPDWEIGEDVYTPGISGDSLRSMSDPAKYGDPDHYSKRYTGTQDNGGVHINSGIINKAAYLISQGGTHYGVSVVGIGRDKLGKIFYRALTQYLTPTSNFSQLRAAAVQSATDLYGSTSQEVASVKQAFDAVGVK

SEQ ID NO: 29219 - protein, 149 aa, Bacillus thuringiensis
NLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGV

SEQ ID NO: 29220 - protein, 151 aa, Bacillus thuringiensis
IYNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGV

SEQ ID NO: 29221 - protein, 148 aa, Bacillus thuringiensis
LLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGV

SEQ ID NO: 29222 - protein, 155 aa, Bacillus thuringiensis
YNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVP

SEQ ID NO: 29223 - protein, 462 aa, Bacillus thuringiensis
MQRMEGKLFMVSKKLQAVTKTVLLSTVLSISLLNNEEVKAEQLNINSQNKYTNFQNLKITDNAEDFKEDKEKAKEWGEEKEKEWKLTATEKGKMNNFLDNKNDIKTNYKEITFSMAGSFEDEIKDLKEIDKIFDKANLSSSIITYKNVEPATIGFNKSLTEGNTINSDAMAQFKEQFLGKDMKFDSYLDTHLTAHQVSSKKRVILKVTVPSGKGSTTPTKAGVILTNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 29224 - protein, 874 aa, Bacillus thuringiensis
MKNMKKKLASVVTCMLLAPMFLNGNVNAVNADSKINQISTTQENQQKEMDRKGLLGYYFKGKDFNNLTMFAPTRDNTLMYDQQTANALLDKKQQEYQSIRWIGLIQSKETGDFTFNLSKDEQAIIEIDGKIISNKGKEKQVVHLEKEKLVPIKIEYQSDTKFNIDSKTFKELKLFKIDSQNQSQQVQLRNPEFNKKESQEFLAKASKTNLFKQKMKRDIDEDTDTDGDSIPDLWEENGYTIQNKVAVKWDDSLASKGYTKFVSNPLDSHTVGDPYTDYEKAARDLDLSNAKETFNPLVAAFPSVNVSMEKVILSPNENLSNSVESHSSTNWSYTNTEGASIEAGGGPLGLSFGVSVNYQHSETVAQEWGTSTGNTSQFNTASAGYLNANVRYNNVGTGAIYDVKPTTSFVLNNNTIATITAKSNSTALSISPGDSYPEIGKNAIAITSMDDFNSHPITLNKQQVNQLLNNKPIMLETDQTDGVYKIRDTHGNIVTGGEWNGVTQQIKAKTASIIVDDGKQVAEKRVAAKDYGHPEDKTPPLTLKDTLKLSYPDEIKETNGLLYYDDKPIYESSVMTYLDENTAKEVKKQINDTTGKFKDVNHLYDVKLTPKMNFTIKMASLYDGAENRSYTGPLGTWYLTYNVVGGNTGKRQYRSAHSSAHVALSSEAKKKLNQNANYYLSMYMKADSTTEPTIEVAGEKSAITSKKVKLNNQNYQRVDILVKNSERNPMDKIYIRGNGTTNVYWDDVTISEVSAINPASLSDEEIQEIFKDSTIEYGNPSFVADAVTFKNIKPLQNYVKEYEIYHKLFSHDSSGNEHITENNFNKEGDLKEDGSVKVDLKDNGLGLWMSVGSNLKVWAITNDGRKIEVLNKNA

SEQ ID NO: 29225 - protein, 96 aa, Bacillus thuringiensis
LKDFEWEFLNTIKEDKGYISTSLSSERLAAFGSRKIILRLQIPKGSKGAYLSAIGGFANEKEILLDKDSKYHINKITEVVIKGIKRYVVDATLLTD

SEQ ID NO: 29226 - protein, 142 aa, Bacillus thuringiensis
MKSMKKKLASVVTCTLLAPMFFNGNVNTAYADNKINQDSSKQEYQQKEMDRKGLLGYYFKDKDFSNLTMFSPTRYNTLIYDQQTANKLLDKKQQEYQSIRWIGLIQSNKTGDFTFELSDDECAIIEMDGKVISNKGKEKQVE

SEQ ID NO: 29227 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSDAPIVDIFNVNNYNLYHSNHKIIQNLNLSN

SEQ ID NO: 29228 - protein, 146 aa, Bacillus thuringiensis
DPIDTTQLLEITEIENPNYVLQAIQLAAAFQDALVPTETEFGEAIRFSMPKGLEVAKTIQPKGAVVAYTDQTLSQSNNQVSVMIDRVISVLKSVMGVALSGSIITQLTAAITDTFTNLNTQKDSAWVFWGKETSHQTNYTYNVLFA

SEQ ID NO: 29229 - protein, 144 aa, Bacillus thuringiensis
INNLLSINEIENTNYLLQAIMLANAFQKALVPTSTEFAEDALRFSMTKGLEVANTISPPGAVVQYVDQNVSQTNNQVSAMINKVLDVLKSILGVALGQSVIEQLTSAVTNTFTNLNTQKNEAWIFWGRETSTQTNYTYNVLFAK

SEQ ID NO: 29230 - protein, 146 aa, Bacillus thuringiensis
SNEINNLLSINEIENTNYLLQAIMLANAFQKALVPTSTEFAEDALRFSMTKGLEVANTISPPGAVVQYVDQNVSQTNNQVSAMINKVLDVLKSILGVALGQSVLEQLTSSVTNTFTNLNIQKIVHCSFWCYSCPRHLFFSSCLYSC

SEQ ID NO: 29231 - protein, 148 aa, Bacillus thuringiensis
GSNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVRFVMN

SEQ ID NO: 29232 - protein, 144 aa, Bacillus thuringiensis
INNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYSYNVLFVTK

SEQ ID NO: 29233 - protein, 104 aa, Bacillus thuringiensis
TINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVE

SEQ ID NO: 29234 - protein, 462 aa, Bacillus thuringiensis
MKRMEGKLFMVSRKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEPKMLIDNGYVLHVDKVSKVVKKGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 29235 - protein, 143 aa, Bacillus thuringiensis
INNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAR

SEQ ID NO: 29236 - protein, 142 aa, Bacillus thuringiensis
INNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFA

SEQ ID NO: 29237 - protein, 100 aa, Bacillus thuringiensis
VIHQTIEVSVMISQIKEIIRSVLGLVINSANFWNSVVSAITNTFTNLEPQVDENWIVWRNLSATQTSYFYKILFSIQNEDTGRFMAILPIAFEITVDVEK

SEQ ID NO: 29238 - protein, 105 aa, Bacillus thuringiensis
TINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVEK

SEQ ID NO: 29239 - protein, 93 aa, Bacillus thuringiensis
EISVMISQIKEIIKSVLGLVINSANFWNNVVSAITNTFTNLEPQVDENWIVWRNLSANQTSYYYKILFSIQNEDTGRFMAVLPIAFEITVDVE

SEQ ID NO: 29240 - protein, 246 aa, Bacillus thuringiensis
YHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 29241 - protein, 462 aa, Bacillus thuringiensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTTPTKAGVILDGNEHKMLIDNGYVLHVDKVSKVVKRGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 29242 - protein, 263 aa, Bacillus thuringiensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 29243 - protein, 225 aa, Bacillus thuringiensis
  MOD_RES (214)..(214): Any amino acid
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNXEYVLIGGDMNV

SEQ ID NO: 29244 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSNAPIVDIFNVNNYNLYHSNHKIIQNLNLSN

SEQ ID NO: 29245 - protein, 778 aa, Bacillus thuringiensis
MKNMKKKLASVVTCMLLAPMFLNGNVNAVNADSKINQISTTQENQQKEMDRKGLLGYYFKGKDFNNLTMFAPTRDNTLMYDQQTANALLDKKQQEYQSIRWIGLIQSKETGDFTFNLSKDEQAIIEIDGKIISNKGKEKQVVHLEKEKLVPIKIEYQSDTKFNIDSKTFKELKLFKIDSQNQSQQVQLRNPEFNKKESQEFLAKASKTNLFKQKMKRDIDEDTDTDGDSIPDLWEENGYTIQNKVAVKWDDSLASKGYTKFVSNPLDSHTVGDPYTDYEKAARDLDLSNAKETFNPLVAAFPSVNVSMEKVILSPNENLSNSVESHSSTNWSYTNTEGASIEAGGGPLGLSFGVSVNYQHSETVAQEWGTSTGNTSQFNTASAGYLNANVRYNNVGTGAIYDVKPTTSFVLNNNTIATITAKSNSTALSISPGDSYPEIGKNAIAITSMDDFNSHPITLNKQQVNQLLNNKPIMLETDQTDGVYKIRDTHGNIVTGGEWNGVTQQIKAKTASIIVDDGKQVAEKRVAAKDYGHPEDKTPPLTLKDTLKLSYPDEIKETNGLLYYDDKPIYESSVMTYLDENTAKEVKKQINDTTGKFKDVNHLYDVKLTPKMNFTIKMASLYDGAENRSYTGPLGTWYLTYNVVGGNTGKRQYRSAHSSAHVALSSEAKKKLNQNANYYLSMYMKADSTTEPTIEVAGEKSAITSKKVKLNNQNYQRVDILVKNSERNPMDKIYIRGNGTTNVYWDDVTISEVSAINPASLSDEEIQEIFKDSTIEYG

SEQ ID NO: 29246 - protein, 262 aa, Bacillus thuringiensis
MHLNNLNNFNNLENNGEYHCSAPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIK

SEQ ID NO: 29247 - protein, 448 aa, Bacillus thuringiensis
MKRMEGKLFMVSRKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKDEPKMLIDNGYVLHVDKVSKVVKKGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 29248 - protein, 508 aa, Bacillus thuringiensis
MQSKVRVIILSTNDPVVNNNTLDITEIKDLAHLSQAIMLANNFQAALVPTSSEFGQDVLRFDVNQGISIANNIYPKAVDINYISRTLSQSNNQVNSMINMVVNELKLLLGINLADSVLQQLTSLVAYTFTNLYTQQNSAWVFWGKQASNQTNYTYNIVFAIQNAQTGNFMKAIPMGFEISAYAVKEQVLFFTIQDYASYSVKIQAINVTQPLINSSYGSLSGVYNIITALNNISVITMSNSDENVNLWYDNDDLNQKWILEFNHNHYAYIIRNLSNRSLVLTWDSTSGSNNVFATSYQGNDEQFWIIQGTDNDYFYLSNMRDTQYVLEIAGSVFYNGTNVIVNKKTSSLNQKFSINRINRQIQNGIYNITTYLNASSVITMSTDYNINVHDYPVNLWFKNDSINQKWIFEFDSDKSAYRVRNVSNPSLFLSWPVASFTNRAAVTPNPRDNEYFWFLQSAGLGTFYLVSMRDTRYVLEVENSNIDNGTNIIVNQRTGNFNQRFYIENIN

SEQ ID NO: 29249 - protein, 156 aa, Bacillus thuringiensis
NTFQGAIDPLTLNFNFEKALQIANGLPNAGVTGTINQSVIHQTIEVSVMISQIKEIIRSVLGLVINSANFWNSVVSAITNTFTNLEPQVDENWVVWRNLSATQTSYFYKILFSIQNEDTGRFMAILPIAFEITVDVQKQQLLFITIKDSARYEVKM

SEQ ID NO: 29250 - protein, 329 aa, Bacillus thuringiensis
MSNKKLILKLFICSTIFITFVFALHDKRVVAASSVNELENWSKWMQPIPDNIPLARISIPGTHDSGTFKLQNPIKQVWGMTQEYDFRYQMDHGARIFDIRGRLTDDNTIVLHHGPLYLYVTLHEFINEAKQFLKDNPSETIIMSLKKEYEDMKGAEGSFSSTFEKNYFVDPIFLKTEGNIKLGDARGKIVLLKRYSGSNESGGYNNFYWPDNETFTTTVNQNVNVTVQDKYKVNYDEKVKSIKDTMDETMNNSEDLNHLYINFTSLSSGGTAWNSPYYYASYINPEIANDIKQKNPTRVGWVIQDYINEKWSPLLYQEVIRANKSLIKE

SEQ ID NO: 29251 - protein, 119 aa, Bacillus thuringiensis
LQIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVGK

SEQ ID NO: 29252 - protein, 249 aa, Bacillus thuringiensis
MENLNHCPLEDIKVNPWKTPQSTARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 29253 - protein, 249 aa, Bacillus thuringiensis
MENLNHCPLEDIKVNPWKTPQSKARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 29254 - protein, 131 aa, Bacillus thuringiensis
MFFLLTKLIISNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWICWGKETANQT

SEQ ID NO: 29255 - protein, 252 aa, Bacillus thuringiensis
MKGKLLKGVLSFGIGLGVLYGGSSAQADTSTDQNNTLKVMTHNVYMLSTNLYPNWGQSERADLIGAADYMKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSY

SEQ ID NO: 29256 - protein, 252 aa, Bacillus thuringiensis
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSY

SEQ ID NO: 29257 - protein, 252 aa, Bacillus thuringiensis
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSY

SEQ ID NO: 29258 - protein, 157 aa, Bacillus thuringiensis
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMK

SEQ ID NO: 29259 - protein, 775 aa, Bacillus thuringiensis
MKNMKKKLASVVTCTLLAPMFLNGNVNAVYADSKTNQISTTQKNQQKEMDRKGLLGYYFKGKDFSNLTMFAPTRDNTLIYDQQTANKLLDKKQQQYQSIRWIGLIQSKEKGDFTFNLSEDEQAIIEIDGKIISNKGKEKQVVHLEKEKLVPIKIEYQSDTKFNIDSKTFKEFKLFKIDSQNQSQQVKRDELRNPEFNKKESREFLAKASKTNFFMQKMKRDIDEDTDTDGDSIPDLWEENGYTIQNKVAVKWDDKFAQQGYVKYLSSPYQAHTVGDPYTDWEKAAGDIPKSNAAATRNPLVAAFPSINVDMRKMILSKDSNLSNSAEAHSNNSYTYANSEGASIEAGFGPKGFSFGVSANYQHTETVGSDWGNSKSNTEQFNSASAGYLNANVHYNNVGTGGIYDAQPTTSFILQDSTIATITAKSNATALSIPSGDRYPASKEGISLKTMDDFNSHPITLNKPQLDAVLNNEVIKINTDQTDGRYGIIGVDGKAEIGDRWSPIIDEIKGRTASIIIDPADGKALETRIAAKDYKNPEDKTPSLTIKEGLKIAYPESISEDKDGILFYEYKNDEGKVTKKQLSEENIMPYLDEDTSKEFERQLSDGSAKGLYDIKLTPKMNITIRLATVTLGFDDQFSAYPWENATWSDKFGNLRLGSLAIPQESKYTIPKDKVKPNYDYLITGYIKHDFTTDNESLGIVAFTKKDNFEMWNMGTSIFSQNSGGEFKKFTIKTQNISGDYILDSIQLMKRNNDVNKIDSYLDDISIIPIGPNKSR

SEQ ID NO: 29260 - protein, 462 aa, Bacillus thuringiensis
MKRMEGKLFMVSTKLQAVTKAVLLSTVLSISLLNNEVIKAEQLNMNSQNKYTNFENLKITDKVEDFKEDKEKAKEWGKEKEKEWKLTATEKGKMNNFLDNKNDIKTNYKEITFSMAGSFEDEIKDLKEIDKIFDKANLSSPIITYKNVEPATIGFNKSLTEGNTINSDAMAQFKEQFLDRDIKFDSYLDTHLTVQQVSSKERVILKVKVPSGKGSTTPTKAGIILNNSEYKMLIDNGYMVHVDKVSKVVKKGVECLQVEGTLKKSLDFKNDINAGAHSWGMKNYEEWAKDLTDLQREALDGYARQDYKEINNYLRNQGGNGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFANEKEILLDKDSKYHIDKVTEVIIKGVKRYVVDATLLTN

SEQ ID NO: 29261 - protein, 231 aa, Bacillus thuringiensis
MFFNRVITLTVPSSDVVNYSEIYQVAPQYVNQALTLAKYFQGAIDGSTLRFDFEKALQIANDIPQAAVVNTLNQTVQQGTVQVSVMIDKIVDIMKNVLSIVIDNKKFWDQVTAAITNTFTNLNSQESERWIFYYKEDAHKTSYYYNILFAIQDEETGGVMATLPIAFDISVDIEKEKVLFVTIKDTENYAVTVKAINVVQALQSSRDSKVVDAFKSPRHLPRKRHKICSNS

SEQ ID NO: 29262 - protein, 263 aa, Bacillus thuringiensis
MHLNNLNNFNNLENNGEYHRSGPIIKKPFRHIALTVPSSDITNFNEIFYVEPQYIAQAIRLTNTFQGAIDPLTLNFNFEKALQIANGLPNAGVTGTIIQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 29263 - protein, 156 aa, Bacillus thuringiensis
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKM

SEQ ID NO: 29264 - protein, 965 aa, Bacillus thuringiensis
  strain Al Hakam
MNKKSKINKVMLSISTMALSLGALQAPVLAEEKVPYNVLKTKPVGIEKPVDEIGHVSKAEETLSFQERLKVGDFSQRPASITNKAAVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRVNSSNQFEYDVVFHGIAKDDEENKAPTVHINGPYNGLVKEGIQFKSDGSKDEDGKIVSYLWDFGDGSTSAEVNPLHVYEREGSYKVALIVKDDKGKESKSETTVTVKDGSLTESEPNNRPEEANRIGLNTTIKGSLIGGDHTDVYTFNVASAKNIDISVLNEYGIGMTWVLHHESDMQNYAAYGQVNGNHIEANFNAKPGKYYLYVYKYDNGDGTYELSVK

SEQ ID NO: 29265 - protein, 378 aa, Bacillus thuringiensis
  strain Al Hakam
MHNVLLLDTFSFGLIRTEIVKDLKKVKSHNRVFGLFITIHMEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVKKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 29266 - protein, 742 aa, Bacillus thuringiensis
  strain Al Hakam
MTIDSMKERNEKMNNKNKGKVFYGNDCCEVRACSHINISKSELTEFVRLLQALGQAIQAVFQNPSQTNIDNLIAALNNLQKFLNCLDLSPAQKQIGNSIIANLLTILRTTPFSCGALYVELQSLLNYLLYIAKLFKVDCCTIDKLVRLITEIQTILVQYGSGCLGGGGATGATGATGPQGATGPQGPAGAQGATGPQGPAGAQGATGPQGPQGAQGPAGVQGATGPQGPQGIQGPAGATGATGAQGPQGIQGPQGVQGPAGATGATGATGAQGPQGVQGPAGATGATGATGAQGPQGVQGPAGATGATGATGAQGPQGVQGPAGATGATGAQGPQGVQGPAGATGATGATGAQGPQGIQGPAGATGATGATGAQGPQGIQGPAGATGATGAQGPQGVQGPAGATGATGATGAQGPQGIQGPAGATGATGAQGPQGVQGPAGATGATGAQGPQGIQGPAGATGATGAQGPQGIQGPAGATGATGAQGPQGVQGPAGATGATGAQGPQGVQGPAGATGATGAQGPQGVQGPAGATGATGATGAQGPQGVQGPAGATGATGATGAQGPQGVQGPAGATGATGATGAQGPQGVQGPAGATGATGATGATGPAGTPIPVTIAAIGNSNPQTISPGTNIQFNQVFEINNINFNDAADTLTILETGVYDISFSASTTFPGSSPFGFGISFNGQPPTRNFSTNVIGSAVSFSTIVTLQAGTTISVQPTANTISIPNTGDTTATLSVFRIY

SEQ ID NO: 29267 - protein, 521 aa, Bacillus thuringiensis
  strain Al Hakam
MPSGNGIRLSYFIRGSGSMFNKKMVAMAMTVPLVMGTLSTVSAVETKKQVKVEAYSPQKQAIEYLKGNANQYGLQPDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDMKNQVHADGEIWSQGQYEMAQAFGRDVATKIILQSHWSLTPNSKFSDGAKAIKQADALLYGGQHAADIDRIWAARGISTN

SEQ ID NO: 29268 - protein, 416 aa, Bacillus thuringiensis
  strain Al Hakam
MAVCMKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQISSIKNVNNQLNKGKGKLSFSMNGNQLKATSSNAGYGISYEDKNWGIFVNGEKIYTFNEKTTVGNISNDINKLNIKGPYIEIKKI

SEQ ID NO: 29269 - protein, 455 aa, Bacillus thuringiensis; identical to SEQ ID NO: 26414
  strain Al Hakam

SEQ ID NO: 29270 - protein, 382 aa, Bacillus thuringiensis; identical to SEQ ID NO: 27355
  strain Al Hakam

SEQ ID NO: 29271 - protein, 251 aa, Bacillus thuringiensis
  strain Al Hakam
MNEKYIILYGTALEPNLIGPTLPPIPPFTFPTGPTGITGPTGATGFTGIGITGPTGVTGPTGIGITGPTGVTGPTGIGITGPTGITGPTGIGITGPTGVTGPTGIGITGPTGATGLGILPVFGTITTDVGIGFSVVVNTNINFTLPGPVSGTTLNPVDNSIIINTTGVYSVSFSIVFVIQAISSSILNLTINDSIQFAIESRIGGGPGVRATSARTDLLSLNQGDVLRVRIREATGDIIYSNASLVVSKVD

SEQ ID NO: 29272 - protein, 984 aa, Bacillus thuringiensis
  strain Al Hakam
MVRYTKKCKVGESMKGYSKKVLVGVSFASLMIGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 29273 - protein, 780 aa, Bacillus thuringiensis
  strain Al Hakam
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGDNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 29274 - protein, 324 aa, Bacillus thuringiensis
  strain Al Hakam
MINMSSWRNNINGYCSCNNQNGVHVDSCCFSCDGTVPKLGPTGPTGATGATGPTGVTGATGVTGATGATGATGATGITGVTGATGVTGATGATGATGATGITGATGPTGATGITGATGITGATGITGTTGATGATGATGATGATGATGATGATGATGATGATGATGATGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 29275 - protein, 863 aa, Bacillus thuringiensis
  strain Al Hakam
MVKVVEGNGGKSKIKSSLNSNFKILSDLVGPTFPPVPTGMTGITGSTGATGNTGPTGSTGPTGETGVTGNTGPTGETGGTGSTGATGNTGPTGETGGTGSTGVTGSTGATGSTGVTGSTGATGNTGATGSMGVTGNTGPTGSTGGTGSTGVTGNTGSTGSTGVTGSTGPTGSTGVTGSTGPTGETGVTGSTGGTGNTGSTGETGPTGSTGPTGETGATGSTGATGNTGATGSMGPTGSTGVTGNTGSTGSTGVTGSTGPTGETGVTGSTGPTGETGVTGSTGPTGETGVTGSTGPTGETGVTGSTGPTGETGPTGSTGETGATGNTGPTGETGSTGTTGPTGETGATGSTGATGSTGPTGSTGETGATGSTGVTGNTGPTGSTGETGATGSTGVTGNTGPTGSTGETGATGSTGVTGNTGPTGSTGATGSTGVTGSTGATGNTGATGETGPTGSTGATGNTGATGETGATGSTGVTGSTGPTGETGPTGSTGVTGNTGLTGSTGVTGSTGPTGSTGPTGETGSTGSTGAPGNTGATGSTGVTGNTGSTGSTGVTGSTGPTGSTGPTGNTGPTGETGATGSTGVTGSTGVTGNTGVTGETGPTGSTGVTGSTGATGSTGVTGNTGATGNTGATGSTGVTGNTGATGETGPTGSTGATGNTGATGETGPTGSIGATGNTGATGNTGETGVTGPTGSTGVTGSTGPTGSTGTTGNTGVTGDTGPTGATGVSTTATYAFANNTSGSVISVLLGGTNISLPNNQNIGPGITVSGGSTVFTVANAGNYYIAYTINLTAGLLVSSRITVNGSPLAGTINSPTVATGSFSATIIASLPAGAAVSLQLFGVVALATLSTVTPGATLTIIRLS

SEQ ID NO: 29276 - protein, 160 aa, Bacillus thuringiensis; identical to SEQ ID NO: 26412
  strain Al Hakam

SEQ ID NO: 29277 - protein, 431 aa, Bacillus thuringiensis; identical to SEQ ID NO: 26106
  strain Al Hakam

SEQ ID NO: 29278 - protein, 564 aa, Bacillus thuringiensis
  strain Al Hakam
MKKLFSMVLAFILMFSTLPSAFAANEAPTKGSLTIHKYAHEKDGQEGEAGTGEPGQKIPEGATPIEGVEYEVIQIASFELITKDGEIVKEGEKEVKNATPIKDKTGKDGTVKFDNLPIGRYLVKEISGPTNVNLNTDPYTIEIPMTDKEGKKLNYDVHIYPKNEIKRGAVELTKTDDAGKPLENVEFTLYHKGTDKVVVDKAGKELKDLKTDKDGKIRVDGLLHGEYYFKESKALPGYVLDPKHREFKIEKSGAFPKDGQAGYGEIVKLDTIINYKKPTIDKKINGNLNGLPINVDEEFTYDIKTTLPGDIHKYKKYVITDNVDPKLTIIGTPVVTIDGEKVSSDVVKVTLGEKTAAGQLVTVTVENFKALEGKKELHLQIKAKVNGDINGGTEIKNIAKIDYETGDEVTPPDDETTTPPVTVIVTDGKISLKKIDGATKDALEGAKFELRKDGKVVKVKGVDVVGVSDKDGMIKWENIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 29279 - protein, 3320 aa, Bacillus thuringiensis
  strain Al Hakam
MFKGGKMKKLFNICLIVFVLFSQFISFPYNQAKAETLQETSLFDTVEMKDGTDHIIDEAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKAEEKSVQIAFPLGTLVQPITVPIQLEDSKEDGTKQDTNKQVPDQVAKPATDNPEQNSATKPATDNPEQNPATRPVTDNPEQNSATKPATDNPEQNPATKPATDNPEQNPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYPLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWVIGFNYNNVEIKDPYVIDVIQDKQKLVPGSIEVRDMILNGSPDNAQPGNAVPTEKYELEEPTEKNKNTLKVHFKQSINSPYYIIFKTSLDGELIQGTYKNEAELKDGSKIVNTLKGDAQVKKGGSFVTKKAVQDDNYINWSIAINESQSTIADAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNNKGQITVEHLKPGTYYLKETKAPEHYKLDDRLIEVKIAEDQTTVINRTATNSLIPGSAILTKVDKDGKTLAGAEFSVRDRKNKIIPGYGKLTTNDQGQIEATNLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTNPIEFTIDKSQQSFATVTATNSLKTGEVELLKVDEFGDKKPLAGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTNPIEFTIKESQGTSPITVTAKNSLTKGGIELTKVNAADEKETLEGAVFKIVNRDTNEDARTNLVTNSEGKLIVDDLRPGNYKLIETKAPTYYDVNVEPIEFTIEKGQQTLLPLTFKNSLTKGKVKLIKEDDVKSSIALAGAVFTLQDANGTEIAKDLKTDEHGVLVIPDLAPGDYQFIETAAPEHYKLDQTPIKFTIKKGSKEDLPVPVTVKNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTNKNGKIYVPDLRPGDYQFIETKAPEHYVLDETPIPFTIERNQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMKGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKRPIVVTVEKSQKNIATVTMKNSLTKGGVELSKVDDVDGTTLEGAVFNIVDMKGTVIRENLTTNSQGKISVSNLRPGDYQFVETKAPKHYDLNKEPIPFTIEKGQAEPISVTAKNSLTKGAVELSKVDDIDGTALEGAVFKIVDMNGNDVRTGITTDAKGKISISDLHPGDYQFIETTAPKHYKLDATPIKFTIEKSQAEKLQVTAKNSLIEGAVELIKVDDINPDTKLSDAVFNIIDAKGQVVRTNLTTDKDGKVSASNLRPGDYQFVETKAPKDYDLNKTPIPFTIEKSQPTHVSVTAKNGLTKGGVELTKVDSLNAKETLEGAVFKITDMNGNDIRTNLVTNKDGKIIAKDLQPGDYQFIETKAPKHYDLNEDPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDVDGSALKDAVFKIVDMNGNNVRSNLTTNKDGKISVSDLRPGDYQFIETKAPTHYDLNQTPINFTVEKSQTTTASVTAKNSLTKGAVELTKVDDIDGATLEGAVFKIVDQNGLDVRTDLTTDKDGKISVSDLRPGDYQFVETKAPTHYDLNQNPINFTVEKSQTTTASVTAKNSLTKGAVELTKVDDIDGATLEGAIFKIVDMNGNDVRSDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPKTQTNKQQDDQNKGKELPNTGHKKDSTQTVGILLLLAGLLSILATKRKKYY

SEQ ID NO: 29280 - protein, 258 aa, Bacillus thuringiensis
  strain Al Hakam
MIVCYDKLGNLTFRPKIIKKGGQNMETLAVLIFLASIVLFVLFIIAIFKKKPKAKLFISSIVCLVLAMVLIPTKDKEEKPKAKETTQQASKEVKEEPKKEEVKKEEPKKKEEPKKEEPKKEEPKKELSKEGESSKVKIAVGSVETVSSVGGEYLNEKAQGVFKVVEISITNNQKDAITVDANSFKLMDNQDREFKYSTQAQTAYDIGNGGKSDFFLNQLNPGLTQTGKIIFDIPADAQGLVLKARGGMMGKEIKLKVE

SEQ ID NO: 29281 - protein, 187 aa, Bacillus thuringiensis; identical to SEQ ID NO: 26615
  strain Al Hakam

SEQ ID NO: 29282 - protein, 315 aa, Bacillus thuringiensis
  strain BMB171
MKRNDNLPLNKGMIGPENIGPTFPILPPIYIPTGATGPTGITGPTGATGPTGITGPTGVTGPTGITGPTGETGPTGITGPTGATGPTGITGRTGATGPTGETGPTGITGPTGATGPTGITGRTGATGPTGITGRTGATGPTGETGPTGITGPTGATGPTGITGPTGATGPTGETGPTGITGPTGATGPTGITGLTGVTGLTGETGPTGATGPTGITGPTGATGPTGGIGPITTTNLLYYTFADGEKLIYTDADGIPQYGTTNILSPSEVSYINLFVNGILQPQPLYEVSTGKLTLLDTQPPSQGSSIILQFIIIN

SEQ ID NO: 29283 - protein, 431 aa, Bacillus thuringiensis
  strain BMB171
MTSNNCFGHNHCNNPIVFTPDCCNNPQTVPITSEQLGRLITLLNSLISAIAAFFANPSDANRLALLNLFTQLLNLLNELAPSPEGNFLKQLIQSIINLLQSPNPNLSQLLSLLQQFYSALAPFFFSLIIDPASLQLLLNLLTQLIGATPGGGATGPTGPTGPGGGATGPTGPTGPGGGATGPTGATGATGATGPTGPTGATGPAGTGGATGLTGATGPTGATGLTGATGLTGATGLTGATGPTGATGPTGATGLTGATGLTGATGATGGGAIIPFASGTTPAALVNALVANTGTLLGFGFSQPGIALTGGTSITLALGVGDYAFVAPRAGVITSLAGFFSATAALAPLSPVQVQIQILTAPAASNTFTVQGAPLLLTPAFAAIAIGSTASGIIPEAIPVAAGDKILLYVSLTAASPIAAVAGFVSAGINIV

SEQ ID NO: 29284 - protein, 163 aa, Bacillus thuringiensis; identical to SEQ ID NO: 26493
  strain BMB171

SEQ ID NO: 29285 - protein, 960 aa, Bacillus thuringiensis
  strain BMB171
MNKNLKFTQLILGISTMALSIGSIQTQVSAEEKAPYNVLQVKPMGTETSKDEIVHATKADETLTFEERLKVGDFSQRPTPVMKRDESQLKKSYTLAELNKMPDSELIDTLSKISWNQITDLFQFNQDTKAFYQNKERMNVIIDELGQRGRAFTKEDSKGIETFVEVLRSAFYVGYYNNELTYLKERSFHDKCLPALKAIAKNPSFTLGTAEQDRVVAAYGKLIGNASSDTETVQYVVNVLKQYNDNLSTYVTDYAKGQAVYEIVKGIDYDIQSYLQDTNKKLNETMWYGKIDNFINEVSRIALVGNITNENSWLINNGIYYAGRLGKFHSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTVKQTLFSKYGSWDFYKYSFALQSYLYNHQFETFDKLQDLIRANDVKKYDSYRESLSNNTQLNAEYQAYMQQLIDNQDKYNIPQVTNDYLIQHAPKPLAEVKNEIVDVANIKDAQITKYESQFFNTFIVEGKYTGGTSKGESEDWKAMSKQVNQTLEQLSQKGWSGYKTVTAYFVNYRVNAANQFEYDIIFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQIGESLEEEKVLPFNKLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 29286 - protein, 553 aa, Bacillus thuringiensis
  strain BMB171
MKKIFSVLLVFFLTFSTWSSVLVKADSPSKGTLTIHKYEQEKDGAQGLEGDGSANQEVPKDAKPLKGVTFEVKKVASFEKISNDGKIVKEDVKPVMGATPNQVVTDDNGQAVLKDLPLGRYEVKEVAGPPHVNLNLNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 29287 - protein, 56 aa, Bacillus thuringiensis
  strain BMB171
MKPEVRLEKLIKEPQVKTERELPKTGAASPWMMSVGAGISFLVGGVLFVLGRRRKQ

SEQ ID NO: 29288 - protein, 163 aa, Bacillus thuringiensis; identical to SEQ ID NO: 26501
  strain BMB171

SEQ ID NO: 29289 - protein, 455 aa, Bacillus thuringiensis
  strain BMB171
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGSILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTTSYMDKNLLANTTYKYVVKAVDVAGNESVQSDIFTITTKTESASYEAWDAKKAYKKGDRVLHEGKVYEAVQSHQGNGDPNWIYALSLWKTV

SEQ ID NO: 29290 - protein, 965 aa, Bacillus thuringiensis; identical to SEQ ID NO: 28390
  strain BMB171

SEQ ID NO: 29291 - protein, 431 aa, Bacillus thuringiensis
  strain BMB171
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 29292 - protein, 568 aa, Bacillus thuringiensis
  strain BMB171
MKKVFSMVLAFILMFSTLPSAFAANEAKTKGSLTIHKYAHEKDGQKGEEGTGEDGQKIPDGATPIEGVEYEVLQIESFEVMTKDGEVVKEAVKKVENAKPFIAKTGKDGTVKFDNLPIGRYLVKEISGPANVNLNTEPYTIDIPMTDKEGKKLNYDVHIYPKNEIKRGAVELTKKDDAGKPLKDVEFTLYHKETDKVVTTQDGKELKGLKTDAEGKIRVDGLLYGEYYFKESKALEGYVLDPKKYEFKVEKSGAFPKDGQAGYGEIVKLKEITNYKKTTIDKKINGNLSGLPINVNEEFTYDIKTTLPGDIHTYKKYVVTDKVDPRLTIIGTPVVTIDGKEVPSDVVKVTLGAKTAEGQLVTVTVENFEALKGKKELHLQIKAKVNADIKGGEKIENIANIDYETGDKVTPEPGDKTTTPPVTVVVTAGKISLKKIDGESKEVLKGAKFKLQDKDGNVIKVNGVEQVGESNAEGMINWAEIPYGEYEIVEIEAPTYKNDKGEVKSYQKLREPIKVTINKDNQTVNLTVENNKSGWILPATGGIGTILFTVVGLVLMGAAFMFLRRKAQ

SEQ ID NO: 29293 - protein, 333 aa, Bacillus thuringiensis; identical to SEQ ID NO: 26898
  strain BMB171

SEQ ID NO: 29294 - protein, 878 aa, Bacillus thuringiensis
  strain BMB171
MVKYSKISKWILGVGLVTITCNGLQIQAETKEQNVKNVLQMEPVGIQKSVDELAHPSKVQENASFTKRLKLADLSQRPLAPTDNIKSLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKIIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 29295 - protein, 370 aa, Bacillus thuringiensis; identical to SEQ ID NO: 28407
  strain BMB171

SEQ ID NO: 29296 - protein, 181 aa, Bacillus thuringiensis
  strain BMB171
MNKKLLASLLCSTFLFGVSACSSHDTPAKNEQATSKKTENDKLSSKDPQKELPTNVDSSDVYMSMGSAESLDVLGTGEVKAQGVFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 29297 - protein, 183 aa, Bacillus thuringiensis; identical to SEQ ID NO: 27306
  strain BMB171

SEQ ID NO: 29298 - protein, 148 aa, Bacillus thuringiensis
  strain BMB171
MTGATGLPSGGGYFFSTATSAIAANALIPINSGSTIFGSGISLTSATTVTLSTPGIYLVSYYFQGDPTAGNETISVRLTLNGTQVAGSFIFYVTGGTFILEPAVSNTMVIEVTSSNATLSLQNGPLAIGHVTTLSGVITASLNVLKIV

SEQ ID NO: 29299 - protein, 368 aa, Bacillus thuringiensis
  strain BMB171
MQLCITIHSVLFPCYDINVIRHISTKIKGSDCMKRSKTYLKCLALSAVFASSAVTLSTPATYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKLFTLDWKNKKLVEKK

SEQ ID NO: 29300 - protein, 237 aa, Bacillus thuringiensis
  strain BMB171
MNEEYSILHGPALEPNLIGPTLPSIPPFTFPTGPTGITGPTGATGFTGIGITGPTGVTGPTGIGITGPTGATGPTGIGITGPTGVTGPTGIGITGPTGATGLGILPIFGTITSEVGIGFSAVVNTNINFTIPGPASGTTLNPLNNSITIDTTGVYSVSFSIVFVIQAISSSILNLTINDSIQFAIETRVGGASGVRATSARTDLLPLNQGDVLRVRIREATGDIIYSNASLVVIKVD

SEQ ID NO: 29301 - protein, 513 aa, Bacillus thuringiensis
  strain BMB171
MFKRITIVGLSVVMFLPSIYEGSKAYADTVNNGTLMQYFEWYAPNDGNHWNRLRTDVENLAEKGITSVWIPPAYKGTTQNDVGYGAYDLYDLGEFNQKGTVRTKYGTKAQLKSAIDALHKKNIDVYGDVVMNHKGGADYTETVTAVEVDPSNRNVEVSGDYEISAWTGFNFPGRGDSYSNFKWKWYHFDGTDWDEGRKLNRIYKFRGIGKAWDWEVSSENGNYDYLMYADLDFDHPDVANEMKKWGTWYANELNLDGFRLDAVKHIDHEYLRDWVNHVRQQTGKEMFTVAEYWQNDIQTLNNYLAKVNYNQSVFDAPLHYNFHYASTGNGNYDMRNILKGTVVANHPTLAVTLVENHDSQPGQSLESVVSPWFKPLAYAFILTRAEGYPSVFYGDYYGTKGNSNYEIPALKDKIDPILTARKNFAYGTQRDYFDHPDVIGWTREGDSVHANSGLATLISDGPGGAKWMDVGKNNAGEVWYDITGNQTNTVTINKDGWGQFQVSGGSVSIYVQQ

SEQ ID NO: 29302 - protein, 916 aa, Bacillus thuringiensis
  strain BMB171
MIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKTQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 29303 - protein, 928 aa, Bacillus thuringiensis
  strain BMB171
MEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLENGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGINTEEGAENKAPVAVINGPYSGNVNEAISFKSDGSKDEDGKITLYRWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYSGGTGNYTVEVK

SEQ ID NO: 29304 - protein, 298 aa, Bacillus thuringiensis
  strain BMB171
MSNNNYSNGLNPDESLSASAFDPNLVGPTLPPIPPFTLPTGPTGPTGPTGPTGPTGPTVPTGPTGPTGPTGPTGPTGPTGGTGTTGPTGPTGDTGATGPTGPTGDTGATGPTGPTGDTGATGPTGPTGDTGATGPTGPTGDTGATGPTGPTGATGPTGPTGPSGLGLPAGLYAFNSAGISLDLGLNAPVPFNTVGSQFGTAISQLDADTFVIAETGFYKITVIVYTAAISVLGGLTIQVNGVSVPGTGATLISVGAPIVVQAITQITTTPSLVEVIVTGLGLSLALGTNASIIIEKIA

SEQ ID NO: 29305 - protein, 365 aa, Bacillus thuringiensis
  strain BMB171
MLNKQGITISLCMIVRDEEETIARCLETVEKIVDEIIVVDTGSVDRTKEIVEKYTSNIYDFQWIDDFAAARNFSFSKATQEYILWLDADDVLLEDAQEALKLLKRELDPKIDAVSMPYHLALDSNGKPLYCTKRNRLVKREKQFQWFGKVHEYLAISGEVFSSNVAITHKKEKKVTNRNLKIFQNTVAAGEELSPRDLFYYANESTDNQKYDDAVLLYETFLNQDEGWYEEKIYACGKLGDCYAKLGMWEKAIESCVKSFRYDVPRGENCTRIGYIYMEQEKYNEAIFWFKLATEVPMATESPFHSPASYTWLPYLQMCICYSRLGEQDKAYYYNELAASYVPNNAAIEYNRKYFRGVFDKPYKV

SEQ ID NO: 29306 - protein, 775 aa, Bacillus thuringiensis
  strain BMB171
MKKSKKMLAGATLAIGVIAPQVMPATAHADENTGESTVNLRILETSDIHVNLMNYDYYQTKTDNKVGLVQTATLVNKAREEVKNSVLFDDGDALQGTPLGDYVANKIKDKDPKNPVDPNYVHPLYRVMNLMKYDVISLGNHEFNYGLDYLKEVTSKTKIPVINSNVYIDDHDGNDENDEHYFDRPYHILEKEVVDEAGQKQIVKIGVMGFVPPQIMNWDKANLEGQVKAKDIVETAKKMVPKMKAEGADVIVALAHSGVDKSGYNVGMENASYYLTEVPDVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANANRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 29307 - protein, 179 aa, Bacillus thuringiensis; identical to SEQ ID NO: 26496
  strain BMB171

SEQ ID NO: 29308 - protein, 503 aa, Bacillus thuringiensis
  strain BMB171
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 29309 - protein, 393 aa, Bacillus thuringiensis
  strain BMB171
MSDENEKKYSNELAQADFISAAAFDPSLVGPTLPPTPPFTLPTGPTGATGPTGATGPTGATGSTGVTGPTGVTGPTGATGPTGATGSTGVTGPTGATGPSGATGSTGTTGPTGDTGPTGITGPTGVTGPTGITGPTGATGTTGSTGPTGVTGPTGATGPTGATGPTGATGSTGVTGPTGVTGPTGATGPTGVTGPTGATGPTGATGPTGATGPTGATGPTGATGPTGATGATATTSTKAILFGGTNAGFQRIAGSPGADSQTLPYVTAGAGSVVAFSASINVNNLGTGVYLLRVCDNVPTNLASPGAGQIVSTITLTLTANITGTIVFSIKPTDIGAQPVKVFNPNPVVAPATVTWTSTIPGNPVARTDAISLFITPGITQSAVYSVFISTAV

SEQ ID NO: 29310 - protein, 163 aa, Bacillus thuringiensis Bt407
MLKKVSQIVLIFGIAFSLSACTETKDSNESKQEDVQDKVYKIGETVDVDGLQVTIDSVKLGYLDYDEDKKKEEILGVIFKVENNSKKEIPFAFYEFEITDKKGTRFKEYNNPDSFISKKLAPDEKIQDIMLFDVAKENTYIATYRPEFTRENRTIKFELKPNK

SEQ ID NO: 29311 - protein, 949 aa, Bacillus thuringiensis Bt407
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDSCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNLNKGLEVVTKAMHMYPLLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVAGDYLAEHATKSLTAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYNGLVKEGIQFKSDDSNDEDGKIVSYLWEFGDGSTSAEVNPVHVYEKEGSYKVSLRVKDDKGKESRSETTVTIKDGSLTESEPNNRPEEANRIELNSKIKGSLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 29312 - protein, 176 aa, Bacillus thuringiensis Bt407
MYKKLGTIALTGALAFSLAACGETEVKEVSKNDAPKQAEKKDKKEKAESKIYKIGDTVEVNGLQLTFSSAKFVEPNEYIKAEKGKVLEIAFNAKNNGKKDIYFGTSELKIADTNGNQFKEYFGGDNTFINENIAPGNQITNKMLFDVPEGDKFVGTFKPTFTFDEKSVKFEFEVAK

SEQ ID NO: 29313 - protein, 348 aa, Bacillus thuringiensis Bt407; identical to SEQ ID NO: 28304

SEQ ID NO: 29314 - protein, 183 aa, Bacillus thuringiensis Bt407; identical to SEQ ID NO: 26916

SEQ ID NO: 29315 - protein, 336 aa, Bacillus thuringiensis Bt407; identical to SEQ ID NO: 27901

SEQ ID NO: 29316 - protein, 503 aa, Bacillus thuringiensis Bt407; identical to SEQ ID NO: 26634

SEQ ID NO: 29317 - protein, 859 aa, Bacillus thuringiensis Bt407
MQVEIQEDSFRTGDLTQPSKKTPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKTVIFVDENHGQASNAYQVTFAATTPNYVSGTYLVNAHNGEMLKDMVQESSLKISEEYVQSVKENKTSNFTSLTGTGKDDLGVTRTFGISKQTSGNYALADYTRGQGIETYDVKYRDITNEESYYPGILTTSASTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINKGEFNWTIGEQTGSIFRNMKNPTAINFSEGLPYPDDYSKYNDLNGEDYGGVHFNSSIINKVAYLIAQGGTHNGVNVNGIGEDKMFDIFYYANTDELNMTSDFSELRLACLTVATNKYGTNSIEVQAIQNAFDAAKITGTVKENEKTVENQAPELTVPITITLRVGDTFDPMRNVKAVDKEDGDLTNKVKHKGDVDTSKPGTYIVEYLVVDSQGRNTTARQTVIVEKNGETSDLEPKLTVPVGATIHVGDSFVPMAEVLAIDKEDGDLTSEIKVDGEVDTSKAGTYILTYTVTDSKGHEVTAKQTVTVKVREEVKNDKPILKVPATTSITEGDQFDPLVGVSATDKEDGDLTSKVAYEGTIDTTKAGTYEIIYSVRDSVGNEVNTIQKVLVKDKETSKPNGLANKTNNNNISNNSNTDKKEYTYKELPKTGVSTTNSAAIGILMIIAGTVLTLIRKFRKIQK

SEQ ID NO: 29318 - protein, 563 aa, Bacillus thuringiensis Bt407
MIEVVKGIREMKKIFSVLLVFFLTFSTWSSVLVKADSPSKGTLTIHKYEQEKDGAQGLEGDGSANQEVPKDAKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLEYGEYYFQETKAPKGYVIDPTKREFFVKNSGTINEDGTITSGTVVKLEVKNYEEPTIDKKINGKSEALPINPLTNYNYDIKTLIPEDIKEYKKYVVTDTLDNRLVIQGKPIVKIDGAEVNTSIVEIAIEGQKVTATVKDFTKLDGKKEFHLQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 29319 - protein, 878 aa, Bacillus thuringiensis Bt407
MVKYSKISKWILGVGLVTITCNGLQIQAETKEKNVKNVLQMEPVGIQKSVDELAHPSKVQENASFTKRLKLADLSQRPLAPNDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDITSDITNEAKLKDVKVTKNKSQFFNTFTLQGTYTGSAAKGEVEDWKVMNEATNDMLKRLSGKEWTGYKTLTAYFVNYRVNNAGQYEYDVVFSGVNTEEGTAVEKEPNNSFETANPLSLNILLRGTLSDQDQGDKFVIDVKDQKDLQISVTNEQNLGLNWVLYSESDLNNYVAYATKCDGNKLLGNYNAKPGKYYLSVYKYGGGTGNYTVQVK

SEQ ID NO: 29320 - protein, 378 aa, Bacillus thuringiensis Bt407
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGVLLLTRNKIKKYL

SEQ ID NO: 29321 - protein, 614 aa, Bacillus thuringiensis Bt407
MALPLPLIGATGPTGNSGPIGPTGGHEGPVGPTGVTGPTGATGPQGPQGIRGIQGPRGTTGAQGIQGAIGDTGEQGITGPTGLQGAQGLIGNQGLIGDIGVQGLEGIQGATGPAGSQGIQGTQGIQGEIGERGQTGAQGMQGERGITGVSGVTGPQGPQGVQGIQGEQGAIGIQGEDGLQGIQGITGEEGPQGAQGIQGEVGPTGSTGIQGAQGISGIKGITGAIGLQGPQGVQGIQGITGATGFQGIKGIRGITGATGSIGIQGLEGPPGGPTGTTGPIGPSSGVTGPSGPPGPPGGPTGPTGATGSTGVSGEIGPIGAQGVQGITGPTGHQGVRGAQGSQGVVGAVGVQGAQGPQGNQGITGPTGAEGSQGIQGPLGVTGPTGAEGPKGIQGIQGVIGPTGAQGMVGIQGVSGPVGVTGATGATGQTGATGATGPTGIQGIQGITGATGETGPTGATGPTGLTGATGSSAISTGGGYFFSTSTSTIAANANIPINSGSTVYGTGVSLTSATTVTVATPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 29322 - protein, 138 aa, Bacillus thuringiensis Bt407
MVSIVIELFNGFRVVPLAGPGMVKLIFVLTTAEKPIPTSEVIVPNMGRIPKPVAPVGPVIPIPVEPVTPVGPVIPIPVGPVTPVGPVIPIPVKPVAPVGPVIPVGPVGNVNGGIDGSVGPIKFGSRAGPCKILYSSLI

SEQ ID NO: 29323 - protein, 84 aa, Bacillus thuringiensis Bt407; identical to SEQ ID NO: 27275

SEQ ID NO: 29324 - protein, 458 aa, Bacillus thuringiensis Bt407
MNLKLTSKLERLRKSKKGIGACLLAAGVTAITMIPQSAYAHGFVEKPSSRAALCSQNYGALNLNCGNVMYEPQSLEAPKGFPDGGPIDGKIASAGGLFGGTLDQQTTNRWFKNTIKGGENTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDKEAPTQPKGLHSMGTTATTVDLMWSPSEDNVDVDHYIVYRESAGVMNKIGTSANTSFIDKGLKANTSYKYVVTAVDLAGNESSRSDVLNITTKLEDSTYEKWDARKVYTKGDRVVHEGKVYEAVQDHQGNGDSNWIFALSLWKPVLNK

SEQ ID NO: 29325 - protein, 746 aa, Bacillus thuringiensis Bt407
MGNNSKHKTRKILAATATVTMLATGMMSSSDVFAEQKEQQKKLSTSLQSEKSVKSENRTFTVPGKGDVEVLKQQERKSMAFSPYEPTGLYAKPNEQITINVEGNQDIQVYIGTYSYDASWREDSKIKSFTLKPGINTIQSPNGGLIYFYNKQQGGTIRTTITTGGTTTPFFELGKHTKQDLINMLDQYPNAHAVELKGERVLITASPERVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDANPIKPDMPNVNNILEGNQFAWSLKGIGDFEFAKVNLNKSTEEMQIDLKAGVPHNYFNSTYASIKVQNTSGKVVYNKEFYGNKQQNAGTQKVSVKTGDFIELTHLEGGERATLINLDNNKRESLDKKVMYEVTKDGLKKVNQIVNPKPDTEAPTQPQGLYANNLTSNSVELKWNPSTDNIGVKEYQVLRDGQLIQTVQGTTFIDQNLTANKEYKYAVKAVDAAGNTSIQSEILPVKTKDQNVSYEKWDPKKAYTKGDKVEHQGTVYEAVQNHQGNGDPNWIFALSLWKPLTIK

SEQ ID NO: 29326 - protein, 412 aa, Bacillus thuringiensis Bt407
MKKAKEIAKCVAVASVIMSGSFGLQATSAFADSKGTVENLQNGGKVYNSFKTTYDMKQNIKNSVKVSFIEDPYADKKIAIVTTDGSNIDAKYTINSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRVSDQYNIEWVSSKWWGTNNKDTYNEFFTNHYKLDWKNHQVTLDNQKALEEQMNSINSVNDKLNKGKGKLSLSINGNQLKATSSNAGYGISYEDKNWGIFVNGEKVYTFNEKSTVGNISNDINKLNIKGPYIEIKQI

SEQ ID NO: 29327 - protein, 1062 aa, Bacillus thuringiensis Bt407
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKTSPHGYVLVKEPIMFEIKEHGKIIELLAVNHHIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKEGKTVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVITTHADINDIGQTVRFVEPSIKTTATNKADGSKELDASKSVTIQDTVEYKDLIVGKEYVVKGKLMDKATNKPLLVDGKEVTVESKFIAKEKNGSITLDFTFNASALQGKEVVVFEELYQDNILVAIHAEIEDKGQTVKFKEVKPEQPKPEQPNSDKNTPTPEQPNEQVKEQPQPKQEIQSKIGWLPQTGTNLTSWISMAAGALLLIVGGVIFLKRKNA

SEQ ID NO: 29328 - protein, 971 aa, Bacillus thuringiensis Bt407
MKGYSKKMLVGVSFASLMLGSFQGGSLAEDTKGEQVSYRNVLKMEPVGVQLPVQELAHSSKVLESKSFEKRLQFADLSQRPPEVKKENKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNCEKYNVPLVSDDYLANHAPKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKIISYKWEFGDGTVSNEQNPTHVYIKEGTYTAKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYSGGTGNYTVEVK

SEQ ID NO: 29329 - protein, 368 aa, Bacillus thuringiensis Bt407
MIALKRSNVKEVINMSSWSNNVNGYCGCNNQNGVHVDSCCFSCDGTVPKVGPTGPTGATGATGGAGPTGATGGTGPMGATGVTGDTGPTGATGITGATGPTGATGITGATGPTGATGITGITGATGPTGATGVTGITGITGATGPTGATGVTGSTGATGPTGATGSTGATGPTGATGPTGATGATGSTGVTGPTGATGSTGSTGPTGTTGSTGPTGATGATGSTGSTGATGTSITATYAFANNTSGTAISVVLGGTNVPLPNNQNIGPGITVSGGNTVFTVANAGNYYISYTINITASLLVSSRITINGGALAGTINSPAVATTSFSATIITTLAAGDAISLQLFGLLAVATLSTTTPGAVLTIIRLS

SEQ ID NO: 29330 - protein, 1225 aa, Bacillus thuringiensis Bt407
MKNRDNNRKQNSLSSNFRIPPELIGPTFPPVPTGFTGIGITGPTGPQGPTGPQGVQGIQGPVGPIGATGPEGQQGPQGLRGPQGETGATGPQGVQGLQGPIGPTGATGAQGIQGIQGLQGPIGATGPEGPQGIQGVQGLPGATGPQGIQGAQGVQGTQGPSGNTGATGATGQGITGPTGITGPTGITGPSGGPPGPTGPTGATGPGGGPSGSTGATGATGSTGATGSTGVTGATGTTGPTGSTGAQGLQGIQGIQGPIGPTGPEGPQGIQGIPGPTGITGEQGIQGVQGIQGIMGATGDQGPQGIQGAIGPQGATGATGDQGPQGIQGVPGPSGATGPQGVQGIQGPMGDIGPTGPEGPEGLQGPQGIQGVPGPAGATGPEGPQGIQGIQGPVGATGSQGPQGIQGIQGVQGITGATGVQGATGIQGIQGEIGATGPEGPQGVQGAQGAIGPTGPMGAQGVQGIQGIQGPTGAQGVQGAQGIQGIQGPTGATGDMGATGATGEGTTGPTGVTGPTGVTGPSGGPAGPTGPTGPSGPAGVTGPSGGPPGPTGATGSTGVTGDTGATGSTGVTGATGETGATGVTGLQGPQGIQGVQGEIGPTGPQGVQGPQGIQGVTGATGDQGPQGIQGPQGDIGPTGPQGIQGLQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGATGPEGPQGVQGVQGAIGPTGPMGTQGVQGIQGIQGATGAQGVQGPQGIQGIQGPTGVTGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGTTGATGAQGPQGIQGPQGDIGPTGPQGPQGIQGPQGIQGPTGATGATGATGPQGIQGPQGIQGPTGATGATGSQGPTGDTGPTGAGATGATGGTGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 29331 - protein, 3395 aa, Bacillus thuringiensis Bt407
MKQVLKCFNVVTMITLLLSIILPSPSAFATEINKKSWDELQGNDVKIKAEQVNAEIYKGEVAEREHVFQYTIENTGATPIQELVLKQSNENEITFPSQSVKVNGEKLPESKVADFYVEEKDKGGKVLSSNLKIKDLKSHEKMTVLIKARRAQHFNKEYKQKISVQKDQLQIGNMSVDVEGLPSEEKLEANTDDEADSSKKAIGSTTDSKAKEVDAKVSAEDKNKLAPKTEIEKIKQPEAEKQLEKEKKQSPLAVKQSDAEVQAASENASKVQIQTGDKQGFGDPLYSTIAPGNLVQTGNVTLGLTTDHYGRQSMGYKTNKMIVDVDNDDSTFNSSTGAFPNIPAGSKVKKAYLFWTAAMGTVTSTNVNQRVSDNDVRQPVKMKMGNKEYADVTADSIRKADSLPFISNYSGAGAGYVAYADVTNVIAQQGISQTLTVANVPQIKDVTGGGYYWGNWNLILVYENYKETVKDMKIWEGLVSQKSTAWTDISVNKINTPKEGTFKAKFSYFSSQGDPADNDVYAYDYGEYDFGLGYQKFKNIKGKDNDVNDSSMTEVQVDGTNEFVTKKYPGYNPDWRNSFSTDIHTYHLEGPNQVKNDLKEAKMRFRANSGYGDIYVLNNATFVTEHNAPNLQVDKKALDSAGKEVKEIKAGEEFTYQIEVKNDTKNNQAPVSNVKGFDKLDDRLEYVPESIQYISGSNKGNKTDNASDDEAEFVNNQIDFRMGEGADAKDGGVLKPGESTIITFKVKVKASVQSDTTIKNIVAVKGKDSTEVNYETADDANVTVTLPKEVPGEIEARKIASNKTPKLGDEVEYRIIFKNTIKGGRLDVLTIEDELPSNLEYVKDSLKAEGAKPEPVELKFENGKVIAKYPEIMDMEERSIVFKTKVKETAKIGEEIVNKATVSDKTNPPKDLEEKITPQHKAGKIAAKKKATNKKPKLGEEIEYQISFKNTVENGKLDAVTIEDEIPANLEFVQGSERAEGAEPNPVELKVENGKVIAKYPEIMDTKERSIAFKVKVKEEAKAGETIVNKAVVSEPNGQTEHPEEKITPDYKYGKVDVEKSVTNQTPKLGEEVEYRITFYNTVENGKLEKVLVEDTLPKGVEYVKDSLKAEGIKPEPVELKVEDGKVMAKYPEITDTEKRSIVFKVKVKDSAKVGQAIVNKAIAKDPKNEPVESKVVITPQSKKGEVAATKVVNNKKPKLGEEIEYRISFHNTVENGKLEEVRVEDTIPKGLEYVENSIKAEGEAPGPVELAVENGIVKAKYIDIMDMKERSIVFKVKVKEEGKVDKEIVNKAIVDDTKNPPIEPEERITPQYKDGIIDSKKTVDNPSPKLGEEVEYRISFKNTVENGKLEKVTIEDTIPNGLEYVKGSEKAEGDTPAPLKLSVKDGKVIAEYENITDMKERSIVFKVKVKEEAEVGKEIINKAIVDDMKHPKEPEAKITPLHKDGKIKAKKSVNNETPKLGEEVEYRISMKNTVKNGKLTDVTIEDTLPEGLEYIENSLKAEGAGTDSVELKFENGKVMAKYPEIMDTEERSIVFKVKVKEGVTVGKKIINKATIDDSQNKPVNPTAEIIPQYKDGKLEAKKMVNNETPKLGEEVEYRISFKNTVEHGKLTEVKIEDDLPNGLEYVKDSVKAEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGSKPDPVELKFENGKVMAKYPEITDTEERSITFKVKVKDEVKVGKKIVNKAIIDDTKNKPETPTAEITPQHKDGKVEAKKTVNNETPKLGEEVEYRISFKNTVENGKLAEVTIKDDLPNGLEYVKDSLRAEGSKPDPVELKVKDGKVIAKYPEITDIEERSIVFKAKVKEEFKVGEGIVNKVVVDDTKDPTTSEVTITPEYKDGKLKAEKFVNNKKPKLGEEVEYRISFKNTVENGKLVEVTVEDEIPAGLEYVENSLQAEGSKPSPVELKFENGKVMAKYLEIADTKERSIIFKVKVKEEAEIGKEIVNKAIVVDTKNEPEEPHVEITPQYKDGKIVAQKVANNHKPKLGEEVEYRISFKNTVENGKLAEVNIKDTLPNGLEYVEGSITAEGSKPNPVELQVKNNKVMAKYPEITDTEERSIVFKAKVKESVKVGEEIVNKAIIDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIAAHKKVNNHKPKLGEEIEYRISFNNTVKDGKLAEVKIEDEIPSGLEYVKNSLKAEGDKPAPVELKEEAGKVSAKYENITDVKERSIIFKVKVKDSVEVDKVIVNKAIVDDTKNPPERPEVDITPQHKDGKIKADKKVNKKDPKLGEEVEYRISFKNTVENGKLAEVKIEDEIPSGLEYVKDSLKSEGNEPAPVELKEEAGKITAKYENITDTAERSISFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYKDGALQVEKTVSNHEPKLGEEVEYRISFENTVENGKLTEVKVEDEIPAGLEYVQDSIKSDGPEPHPVELKVENGKVTAKYPEITDTKKRSIIFKAKVQETVQVGKEIINKAVVDDNNPTNPPIESLVPITPQYKDGKLEARKEVSNHEPKLGEEIEYRITFNGIVDGGKLVDVKIEDEIPSGLEYVKDSLKAVGDKPVPTELKVENGKVTVKYPEITDTKERSIIFKVKVKESVKVGEEITNKAIIHVDDPNHPVMEPTATIKPQYKDGKVKATKTVSNKEPKLGEEIEYRISFENTVENGKIAEVKIEDEIPAGLEYVQDSIRFEGAEPNPVELKMEFGKVIAKYLEITDTKERSIIFKAKVKAAPSKGITNRAIVDDRINPPLEPTVTILPKTKEDFKIPEDPKEPKDPKEPKEPEVKPEDPKEPKEPKEPKEPKEPKDPKEPEVKPEDPKEPKEPEVKPEDPKEPKDPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKDLKQPEVRLEKLIKEPQVKTERELPKTGAASPWMMSVGAGISFLVGGVLFVLGRRRKQ

SEQ ID NO: 29332 - protein, 431 aa, Bacillus thuringiensis Bt407; identical to SEQ ID NO: 26534

SEQ ID NO: 29333 - protein, 797 aa, Bacillus thuringiensis Bt407
MTEVLSLKVENEQLDKGSVEITKVDKDSQKALEGVTFEVQDEKGKVVTKVTTDKEGKVKISDLSVGSYKLVEVENLPGYKKLTEPVSFEIKKGMTEVLSLKVENEQLDKGSVEITKVDKDSQKVLEGVVFEVQDEQGKVVTEVKTDKNGKAKISDLSVGKYKLVEKESLPGYKKLTEPVSFEIKKGMTEVLSLKIENEMVDTGNVEITKIDKDNKAPLAGVVFEVQDDKGKVVTKVTTDKAGKATVSDLSVGKYKLVEVDSLPGYKKLEKPVPFEIKKGMTKSLTFTVENEMVDTGNVEITKIDKDSKARLENVVFEVRDSKGKVVAKVTTDKEGKANVSDLSIGKYELVEVETPAGYKPLEKPVSFEIEKGRVTALQLTVENELVDTGNIEITKVDKENKDALADAVFEIQDAAGQVVAKITTDKKGQAQVTNLSVGTYKLVEVKAPKGYKQLVDPITFQIEKGMTKSLALTVENEMLDKGNVEVTKVDKDSQKVLEGVVFEVQDEQGKVVTEVTTDKEGKANVSDLSVGKYKLVETKSLPGYKKLTEPVSFEIKKGMTKVLSLKVENEQLDKGSVEITKMAAESKEVLSGAVFEVHDEKGKVVVKVTTDKGGKAKIADLSVGNYTLVEVEAPKGYEKLTNPIPFEITNGMINAVQLEVLNKLNHLAPPGPETPDPEKPGTPDPEKPGTPDPEKPGTPNPEKPGTPDPEKPGTPNPEKPGTPDPEKPGTPNPEKPGTPDPEKPGTPNPEKPGTPNPEKSEKELPKTGQKMPVEPYMGALLVMMSFGLFVLGRKQQR

SEQ ID NO: 29334 - protein, 304 aa, Bacillus thuringiensis Bt407
MSNNNYSNGLNPDESLSASAFDPNLVGPTLPPIPPFTLPTGPTGPTGPTGPTGPTVPTGPTGPTGPTGPTGPTGPTGPTGPTGPTGDTGTTGPTGPTGDTGATGPTGPTGDTGATGPTGPTGDTGATGPTGPTGDTGATGPTGPTGDTGATGPTGPTGATGPTGPTGPSGLGLPAGLYAFNSAGISLDLGLNAPVPFNTVGSQFGTAISQLDADTFVIAETGFYKITVIVYTAAISVLGGLTIQVNGVSVPGTGATLISVGAPIVVQAITQITTTPSLVEVIVTGLGLSLALGTNASIIIEKVA

SEQ ID NO: 29335 - protein, 965 aa, Bacillus thuringiensis Bt407
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDSCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNLNKGLEVVTKAMHMYPLLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVAGDYLAEHATKSLTAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYNGLVKEGIQFKSDDSNDEDGKIVSYLWEFGDGSTSAEVNPVHVYEKEGSYKVSLRVKDDKGKESRSETTVTIKDGSLTESEPNNRPEEANRIELNSKIKGSLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 29336 - protein, 455 aa, Bacillus thuringiensis Bt407
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINIPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQPSTEYSYTVKAIDSAGNVSKESTALTVKTTDEIPDTEAPTQPKGLHSMGTTASSVDLMWSPSDDNIGVDHYDIYRETEGSMKKIATSNTTSYMDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 29337 - protein, 710 aa, Bacillus thuringiensis Bt407
MSRYNDNQNKFSKPCFPSSAGRIPNTPSIPITKAQLRTFRAIIIDLTKIIPTLFANPSPKNIEDLIDTLNLLSKFICSLDATSSLKAQGLAIIKNLITILRNPTFVASAVFIELQNLINYLLYITKLFRIDSCTLQELLKLIAALQTALVNSASFIQGPTGPTGPAGATGATGPRGNTGATGATGATGPRGNTGATGATGPRGNTGATGATGPQGNTGTTGATGPQGNTGATGVTGATGPRGNTGATGATGPQGNTGATGATGATGPRGNTGATGATGPQGNTGATGATGATGPRGNTGATGATGPQGNTGATGATGATGPQGVQGNTGATGATGPQGAQGNTGATGIGVTGPTGPSGGPQGPTGPQGPQGNTGATGPQGAQGPAGATGATGPQGVQGNTGATGATGATGPQGVQGNTGATGATGPQGVQGNTGATGATGPQGVQGNTGATGATGPQGVQGNTGATGATGPQGVQGNTGATGPQGAQGNTGATGATGPQGVQGNTGATGPQGAQGNTGATGATGATGPQGVQGNTGATGATGPQGIQGPTGATGATGIGVTGPTGPSGGPTGPTGPTGPSFPIATIVVTNNIQQTVLQFNNFIFSTAINVNNIIFNGTDTVTVINGGIYVISVSISTTAPGCAPLGVGISINGAVATDNFSSNLIGDSLSFTTIETLAAGARISVQSTLNEITIPATGNTNIRLTVFRIA

SEQ ID NO: 29338 - protein, 368 aa, Bacillus thuringiensis Bt407
MKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGVLLLTRNKIKKYL

SEQ ID NO: 29339 - protein, 625 aa, Bacillus thuringiensis Bt407
MRHHRNCKKFGVALPLPLIGATGPTGNSGPIGPTGGHEGPVGPTGVTGPTGATGPQGPQGIRGIQGPRGTTGAQGIQGAIGDTGEQGITGPTGLQGAQGLIGNQGLIGDIGVQGLEGIQGATGPAGSQGIQGTQGIQGEIGERGQTGAQGMQGERGITGVSGVTGPQGPQGVQGIQGEQGAIGIQGEDGLQGIQGITGEEGPQGAQGIQGEVGPTGSTGIQGAQGISGIKGITGAIGLQGPQGVQGIQGITGATGFQGIKGIRGITGATGSIGIQGLEGPPGGPTGTTGPIGPSSGVTGPSGPPGPPGGPTGPTGATGSTGVSGEIGPIGAQGVQGITGPTGHQGVRGAQGSQGVVGAVGVQGAQGPQGNQGITGPTGAEGSQGIQGPLGVTGPTGAEGPKGIQGIQGVIGPTGAQGMVGIQGVSGPVGVTGATGATGQTGATGATGPTGIQGIQGITGATGETGPTGATGPTGLTGATGSSAISTGGGYFFSTSTSTIAANANIPINSGSTVYGTGVSLTSATTVTVATPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 29340 - protein, 1093 aa, Bacillus thuringiensis Bt407
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKTSPHGYVLVKEPIMFEIKEHGKIIELLAVNHHIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKEGKTVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVITTHADINDIGQTVRFVEPSIKTTATNKADGSKELDASKSVTIQDTVEYKDLIVGKEYVVKGKLMDKATNKPLLVDGKEVTVESKFIAKEKNGSITLDFTFNASALQGKEVVVFEELYQDNILVAIHAEIEDKGQTVKFKEVKPEQPKPEQPNSDKNTPTPEQPNEQVKEQPQPKQEIQSKIGWLPQTGTNLTSWISMAAGALLLIVGGVIFLKRKNA

SEQ ID NO: 29341 - protein, 354 aa, Bacillus thuringiensis Bt407
MSSWSNNVNGYCGCNNQNGVHVDSCCFSCDGTVPKVGPTGPTGATGATGGAGPTGATGGTGPMGATGVTGDTGPTGATGITGATGPTGATGITGATGPTGATGITGITGATGPTGATGVTGITGITGATGPTGATGVTGSTGATGPTGATGSTGATGPTGATGPTGATGATGSTGVTGPTGATGSTGSTGPTGTTGSTGPTGATGATGSTGSTGATGTSITATYAFANNTSGTAISVVLGGTNVPLPNNQNIGPGITVSGGNTVFTVANAGNYYISYTINITASLLVSSRITINGGALAGTINSPAVATTSFSATIITTLAAGDAISLQLFGLLAVATLSTTTPGAVLTIIRLS

SEQ ID NO: 29342 - protein, 476 aa, Bacillus thuringiensis Bt407
MQGITGATGAQGATGIQGIQGEIGATGPEGPQGVQGVQGAIGPTGPMGTQGVQGIQGIQGATGAQGVQGPQGIQGIQGPTGVTGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGTTGATGAQGPQGIQGPQGDIGPTGPQGPQGIQGPQGIQGPTGATGATGATGPQGIQGPQGIQGPTGATGATGSQGPTGDTGPTGAGATGATGGTGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 29343 - protein, 529 aa, Bacillus thuringiensis Bt407
MDDNNPTNPPIESLVPITPQYKDGKLEARKEVSNHEPKLGEEIEYRITFNGIVDGGKLVDVKIEDEIPSGLEYVKDSLKAVGDKPVPTELKVENGKVTVKYPEITDTKERSIIFKVKVKESVKVGEEITNKAIIHVDDPNHPVMEPTATIKPQYKDGKVKATKTVSNKEPKLGEEIEYRISFENTVENGKIAEVKIEDEIPAGLEYVQDSIRFEGAEPNPVELKMEFGKVIAKYLEITDTKERSIIFKAKVKAAPSKGITNRAIVDDRINPPLEPTVTILPKTKEDFKIPEDPKEPKDPKEPKEPEVKPEDPKEPKEPKEPKEPKEPKDPKEPEVKPEDPKEPKEPEVKPEDPKEPKDPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKDLKQPEVRLEKLIKEPQVKTERELPKTGAASPWMMSVGAGISFLVGGVLFVLGRRRKQ

SEQ ID NO: 29344 - protein, 327 aa, Bacillus thuringiensis Bt407
MKRNDKLSINKGKIEPENIGPTFPALPPIYIPTGATGVTGATGVTGATGATGATGATGATGATGATGATGATGVTGATGATGATGVTGATGATGITGATGITGATGITGATGVTGATGATGATGITGATGTTGVTGATGVTGATGITGITGVTGVTGATGATGATGITGATGTTGVTGVTGVTGATGVTGITGATGITGATGVTGVTGVTGVTGATGATGATGITGATGATGVTGPTGGIGPITTTNLLFYTFSDGEKLIYTDADGIAQYGTTNILSPSEVSYINLFINGILQPQPFYEVSTGKLTLLDNQPPSQGSSIILQFIIIN

SEQ ID NO: 29345 - protein, 893 aa, Bacillus thuringiensis Bt407
MGNKKEIAIVALTTGFVLTSVTPYGVGHAEEPGQMQVEIQEDSFRTGDLTQPSKKTPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKTVIFVDENHGQASNAYQVTFAATTPNYVSGTYLVNAHNGEMLKDMVQESSLKISEEYVQSVKENKTSNFTSLTGTGKDDLGVTRTFGISKQTSGNYALADYTRGQGIETYDVKYRDITNEESYYPGILTTSASTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINKGEFNWTIGEQTGSIFRNMKNPTAINFSEGLPYPDDYSKYNDLNGEDYGGVHFNSSIINKVAYLIAQGGTHNGVNVNGIGEDKMFDIFYYANTDELNMTSDFSELRLACLTVATNKYGTNSIEVQAIQNAFDAAKITGTVKENEKTVENQAPELTVPITITLRVGDTFDPMRNVKAVDKEDGDLTNKVKHKGDVDTSKPGTYIVEYLVVDSQGRNTTARQTVIVEKNGETSDLEPKLTVPVGATIHVGDSFVPMAEVLAIDKEDGDLTSEIKVDGEVDTSKAGTYILTYTVTDSKGHEVTAKQTVTVKVREEVKNDKPILKVPATTSITEGDQFDPLVGVSATDKEDGDLTSKVAYEGTIDTTKAGTYEIIYSVRDSVGNEVNTIQKVLVKDKETSKPNGLANKTNNNNISNNSNTDKKEYTYKELPKTGVSTTNSAAIGILMIIAGTVLTLIRKFRKIQK

SEQ ID NO: 29346 - protein, 223 aa, Bacillus thuringiensis Bt407
MSEEYNILHGPALEPNLIGPTLPSIPPFTFPTGPTGITGPTGATGFTGIGITGPTGVTGPTGIGITGPTGVTGSTGIGITGPTGATGLGILPIFGTITSEVGIGFSAVVNTNINFTIPGPASGTTLNPLNNSITIDTTGVYSVSFSIVFVIQAISSSILNLTINDSIQFAIETRVGGASGVRATSARTDLLPLNQGDVLRVRIREATGDIIYSNASLVVIKVD

SEQ ID NO: 29347 - protein, 314 aa, Bacillus thuringiensis Bt407
MFDKNEIKKINEALQANALDPNIIGPTLPPVPPFTLPTGPTGPTGPTGPTGPTGPTGPTGPTGPTGPTGPTGPTGPTGPTGLTGLTGPTGLTGLTGPTGPTGPTGLTGPTGPTGPTGPTGPTGPTGPTGPTGPTGLTGPTGATEGCLCDCCVFPMQEVLQQLVGQTVILATIADAPNVAPRFFLFNITSVNDFLVTVTDPVSTTTFVVNISDVIGVGFSLTVPPLTLLPPADLGCECDCRERPIRELLDTLIGSTVNLLVSNGSIATGFNVEQTALGIVIGTLPIPINPPPPTLFRFAISTCKITAVDITPTGT

SEQ ID NO: 29348 - protein, 163 aa, Bacillus thuringiensis HD-771
MLKKVSQIVLIFGIAFSLSACTETKDSNESKQEDVQDKVYKIGETVDVDGLQVTIDSVKLGYPDYDEDKKKEEILGVILKVENNSKKEIPFAFYEFEIIDKKGTRFKEYNNPDSFISKKLAPDEKIQDIMLFDVAKENTYIATYRPEFTRENRTIKFELKPNK

SEQ ID NO: 29349 - protein, 176 aa, Bacillus thuringiensis HD-771
MYKKLGTIALTGALAFSLAACGETEVKEVSKNDAPKQAEKKDKKEKAESKIYKIGDTVEVNGLQLTFSSAKFVEPNEYVKAEKGKVLEIAFNAKNNGKKDIYFGTSELKIADTNGNQFKEYFGGENTFINENIAPGNQITNKMLFDVPEGDKFVGTFKPTFTFDEKSVKFEFEVAK

SEQ ID NO: 29350 - protein, 285 aa, Bacillus thuringiensis HD-771
MYQRNCFSCDGRRNSGGSNGNTGPTGSTGATGSTGPSGPTGATGPTGSAGPSGAGFQSTTTFSLAAAPNYKKGQVVTYTGSGYVVKKDAPQGFPNVSPDYIILVESGPTGSTGPTGNTGPMGSAGSASAKSIVFQGTNAGFQRIAGSPGIDSNVIPYVTAGAGSIVGFSASININNLPAAVYTINICRNVPTNLTSPTSSYILSTITLTTTDKITGTMVFSIKPTDSGAGQIQVFNPTPAVGPATVTWTSITTGNPIVRGDAISLYITPGITASAVYSVFLITDI

SEQ ID NO: 29351 - protein, 367 aa, Bacillus thuringiensis HD-771
MKTKKTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 29352 - protein, 455 aa, Bacillus thuringiensis HD-771
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEYSYTVKAIDAAGNVSKESTALTVKTTVATPDTEVPTQPKGLHSMGTTASSVDLMWSPSDDNIGVDHYDIYREIEGLMKKIATSNTTSYMDKNLLANTTYKYVVKAVDVAGNESVQSDIFTITTKDESASYEAWDAKKAYKKGDRVLHEGKVYEAVQSYQGNGDPNWIYALSLWKTV

SEQ ID NO: 29353 - protein, 1009 aa, Bacillus thuringiensis HD-771
MKQNKRKRINAMIIAAALSLPFAVYSTPALAAVAIEANKTGQGLEDGTYDAVIKAYKDKTNEESMAAVYIKDPKLTIENGKKIVTATLSDSDFFQYLKTEDIHTPVVFHDVKVLSEDKKKNGTKVIQFEVGELGKTYNMQMHIYIPTMAYDNKYQVQFEVNAINLENNVSEKQKENKEEQQDENGNVILDKQLQKYINKYNLDRDNVDAPITKKDLLQIKTLSIYSGKGINEIAGLEYMTNLEKLTLRESNVTDISAISKLRSLKYVDLTSNSIESIHPIGQLENINMLFLRDNKISDLTPLSKMKKIKTLDLIGNNIKDIQPLFTLSTMKQLYLANNQISDLNGIDRLNNVELLWIGNNKINNVESISKMSNLIELEIADSEIKDISPLSQLGNLQVLNLEENYISDISPLSTLTNLHEINLGANEISDVRPVEELGKRISIDIQRQKIFLNEASVDEELKIPVYNLKGEPLQNINVKSEGATLNNGFIKWNSPGEKIYEFKLDTNSTESKIRFNGTVIQNIVEKQKERANVILDKTLQQHINKENLGRENLNAPITKEDLLQVKKLEILKEKGNEIKDITGLEYMTNLENLTLEGVGLKNIDFISNLKRLNNVNVSHNQIEDITPLSSLKNLQWLNLTENRITDVTVLGSMLDLLSLKLAENEIRDVRPLIQLGQWVTIDVRRQKVILDDAEINKEVKIPVYDLEGEPIEKITLKSEGGTLTDEGIIWRTLGEKIYEFDLDADHYETSILYSGIVMQNIVEKLIPKEEVKEPTKEVEESKEEVKEPTKEVEETKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 29354 - protein, 553 aa, Bacillus thuringiensis HD-771
MKKIFSVLLVLFLTFSTWSSVLVKADSPSKGTLTIHKYEQEKDGAQGLEGDDSANQEVPKDAKPLKGVTFEVKKVASFEKISNDGKIVKEDVKPVMGATPTQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVIVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 29355 - protein, 503 aa, Bacillus thuringiensis HD-771; identical to SEQ ID NO: 26542

SEQ ID NO: 29356 - protein, 183 aa, Bacillus thuringiensis HD-771
MRKLSILLTFILVLVSVTAACTQDKTDSAVENVPIEEPSAKNVNEELINFEEKEDMSRLEQGILLVGESVKGGYYLTAVQSAYLNDSNDSIIVNVSVKNVRGQTIGLSELKYNLKDEKDGKAYKGKVLDQNPSDIQVKPNETVELKIAFEAPGTVDEYMFYIESSLDPLQTYWKIDKLQSQKN

SEQ ID NO: 29357 - protein, 333 aa, Bacillus thuringiensis HD-771
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINTENKNDSEYASMFKTLNASVPSYTGHTATWDATTNSIAKYNFPDSPAEYLDYIIASKDHANPPYIENKVLQPKSPQWTVTSWFQKYTYNDYSDHYPVEATISMK

SEQ ID NO: 29358 - protein, 458 aa, Bacillus thuringiensis HD-771
MKLKLTSKLERLRTSKKGIGACVLAAGMTAITMAPQSAYAHGFVEKPSSRAALCSQNYGVLNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHTIPDMEAPTQPKGLHSMGTTSTTVDLMWSPSEDNVGVDHYIVYRESAGVMNKIGTAANTSFMDKDLKANTSYNYVVTAVDLAGNESSRSDVLNVTTKSENSAYEKWDARKAYTKGDRVVHEGKVYEAVQNHQGNGDSNWIFALSLWKPVLNK

SEQ ID NO: 29359 - protein, 431 aa, Bacillus thuringiensis HD-771; identical to SEQ ID NO: 26534

SEQ ID NO: 29360 - protein, 291 aa, Bacillus thuringiensis HD-771
MKRNDNLSLNKGMIGPENIGPTFPILPPIYIPTGETGPTGITGATGETGPTGITGPTGITGSTGITGPIGITGATGKTGPIGITGATGETGPTGITGSTGKTGPTGKTGSTGITGPIGITGATGETGPIGITGPTGETGPTGITGSTGITGLTGVTGLTGETGPIGITGPTGATGPTGPTGVTGTTGITGPTGVTGATGPTGGIGPITTTNLLYYTFADGEKLIYTDTDGIPQYGTTNILSPSEVSYINLFVNGILQPQPLYEVSTGKLTLLDTQPPSQGSSIILQFIIIN

SEQ ID NO: 29361 - protein, 698 aa, Bacillus thuringiensis HD-771
MNNNNKKILKEVLDFKLIGPTFQKKPSFKFPVGETGSTGITGPTGPEGAQGSQGITGPTGPTGPEGAQGPQGITGPIGSTGPEGAQGPQGITGPIGSTGPEGAQGPQGITGSIGSTGPEGAQGPQGITGPIGSTGPEGAQGPQGITGPIGPIGPEGAQGPQGITGPSGSSGPISLGVTGAIGSTTVGPTGPTGDNGGPLGPTGPTGEFGPTGPTGITGLIGPTGPEGEQGPQGITGPTGPTGPEGEQGPQGITGPTGPTGPEGEQGPQGITGPTGPTGPEGEQGPQGTIGPIGLTGSEGEQGPQGMTGPIGPTGPEGVQGAQGITGPIGPTGSEGEQGPQGMTGPTGPTGPEGEQGSQGMTGEQGKVGMTGSIGPAGKSGIELPINRIYFMNNSALIDVADGVTNSIINQISPNLILAGNISVDSFTNNIYVASRALFLMDVIDGITNNVITTIQLPNVASTNIAINPLKNRVYVGAGLMGINVIDSITNTILGFISVTSTVIAVNPATNLIYVTSRTGNTVSVINGNTNTVMAVIPIGEEPFGITANPATNLIYVTNRTGNTVSVINGNTNTVMAIIPVGEEPYAITMNPSTNLIYVTNRTGNTVSVINGNTNTVMATIPVGTQPSNIAINPITNLMYVGSFSDGVFVIDLLTNIIIEVIPIALFPLANNGDIFSQIIAINAGDIEYRKAPFYKYIQ

SEQ ID NO: 29362 - protein, 965 aa, Bacillus thuringiensis HD-771
MNKKSKINKVMLSISTMALSLGALQTHAVAEEKVPYNVLKTKPVGIEKPVDEVGHVSKVDETLSFQERLKVGDFSQRPASITKKTAVKQVKESYSMADLNKMNDQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 29363 - protein, 524 aa, Bacillus thuringiensis HD-771
MSRYNDSQNKFSKPCFPSSAGRIPNTPSIPITKAQLRTFRAIIIDLTKIIPKLFANPSPQNIEDLIDTLNLLSKFICSLDATSSLKAQGLAIIKNLITILRNPTFVASAVFIELQNLINYLLYITKLFRIDPCTLQELLKLIAALQTALVNSASFIQGPTGPTGPTGPTGPAGATGATGPRGNTGATGPQGPQGNTGAQGPAGATGATGPQGPQGNTGAQGPAGATGATGPQGPQGNTGATGATGPQGVQGNTGATGATGATGPQGVQGNTGATGATGATGIGVTGPTGPSGGPPGPTGPQGPQGNTGATGATGPQGVQGNTGATGATGPQGVQGNTGATGPQGVQGNTGATGATGPQGIQGPTGATGATGIGVTGPTGPSGGPTGPTGPTGPSFPVATIVVTNNIQQTVLQFNNFIFSTAINVNNIIFNGTDTVTVINGGIYVISVSISTTAPGCAPLGVGISINGAVATDNFSSNLIGDSLSFTTIETLVAGARISVQSTLNEITIPATGNTNIRLTVFRIA

SEQ ID NO: 29364 - protein, 1093 aa, Bacillus thuringiensis HD-771
MGKRVIIRVFTLLSVLALFLNVFLPRASAEVMTHEKYSMNWSYSNSLGKHIRTEMIKNSSGQIAYCLTLGLKSPNGEDLPEMGKTDNVVYRALLNGFPQKSVQQLGVANQNEAHYATQLAVWNALGQLDVNELKHENKNVEKAAKAIISNANNSEETQDVFMNVIPAEKQKAELKGEFFETNLYSVQTNAKGGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGIAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDVSKKLEGAEFELKDASGKVIGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 29365 - protein, 971 aa, Bacillus thuringiensis HD-771
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEDAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGETGNYTVEVK

SEQ ID NO: 29366 - protein, 965 aa, Bacillus thuringiensis HD-789
MNKKSKINKVMLSISTMALSLGALQTHAVAEEKVPYNVLKTKPVGIEKPVDEVGHVSKVDETLSFQERLKVGDFSQRPASITKKTAVKQVKESYSMADLNKMNNQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGNGTYELSVK

SEQ ID NO: 29367 - protein, 183 aa, Bacillus thuringiensis HD-789; identical to SEQ ID NO: 26531

SEQ ID NO: 29368 - protein, 893 aa, Bacillus thuringiensis HD-789
MGNKKEIAIVALTTGFVLTSVTPYGLGHAEETGQMQVEIQEDSFRTGDLTQPSKKAPENVVKDALKENTEHALSPKQVSAETGVDYKVLQKRGSYDGTTLVRMQQIYEGKEVYGHQLIAHVDKKGIIKSISGDSAQNLTQEDLKKPINLSKEEAKQYIYKKYGNDTKFISEPEVKAVIFVDENHGQASNAYQVTFAATIPNYVSGTYLVNAHNGEMLKDMVQESSLKISEEYVQSVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGNKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSIFRNMKNPTAINFSDGLPYPDDYSKYNDLNGEDYGGVHFNSSIINKVANLIAQGGTHNGVNVNGIGEDKMFDIFYYANTDELNMTSNFSELKLACLKVATNKYGTNSIEVQAVQNAFDAAKIIEKVKENEKTAENQAPELTVPFTITLRVGDTFDPMRNVKAVDKEDGDLTNKVKHKGDVNTSKPGTYIVEYLVVDSKGGNATAIQTVIVEGNGEISDLEPKLTVPVGAILHVGDSSVPMAEVLAIDKEDGDLTSKIKVDGEVDTSKAGTYVLTYTVTDSKGHEVTAKQTVTVKVREEIKNEKPILKVPATTSITEGDQFDPLIGVSATDKEDGDLTSKVAYKGTIDTTKAGIYEIIYSVRDSVGNEVNTIQKVLVKDKETSKPNGLANKTNSNSISNNSNTDKKEYTYKELPKTGVSTTNSAAIGILMIITGTVLTLIRKFRKIQK

SEQ ID NO: 29369 - protein, 455 aa, Bacillus thuringiensis HD-789
MNNRFLKQLQNMKMNKKSLGAVALTAGIISTTLIPQNAYAHGFVEKPGSRSALCSPTYGALNVNCGSVMYEPQSLEAPKGFPQGGPVDGQVASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 29370 - protein, 202 aa, Bacillus thuringiensis HD-789
MKKAKEIAKCVAVASVIMSGSFSLQATSAFADSKGTVENLQNGGKVYNSFKTTYDMKQNIKNSIKVSFIEDPYADKKIAIVTTDGSNIDAKYTVNSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFFVN

SEQ ID NO: 29371 - protein, 223 aa, Bacillus thuringiensis HD-789
MLLDLKGLQGNTGATGPQGVQGNTGATGPQGVQGNTGATGPQGVQGNTGATGATGPQGIQGPTGATGATGIGVTGPTGPSGGPTGPTGPTGPSFPVATIVVTNNIQQTVLQFNNFIFSTAINVNNIIFNGTDTVTVINGGIYVISVSISTTAPGCAPLGVGISINGAVATDNFSSNLIGDSLSFTTIETLVAGARISVQSTLNEITIPATGNTNIRLTVFRIA

SEQ ID NO: 29372 - protein, 1009 aa, Bacillus thuringiensis HD-789
MKQNKRKRINAMIIAAALSLPFAVYSTPALAAVAIEANKTGQGLEDGTYDAVIKAYKDKTNEESMAAVYIKDPKLTIENGKKIVTATLSDSDFFQYLKTEDIHTPGVFHDVKVLSEDKKKNGTKVIQFEVGELGKTYNMQMHIYIPTMAYDNKYQVQFEVNAINLENNVSEKQKENKEEQQDENGNVILDKQLQKYINKYNLDRDNVDAPITKKDLLQIKTLSIYSGKGINEIAGLEYMTNLEKLTLRESNVTDISAISKLRSLKYVDLTSNSIESIHPIGQLENINMLFLRDNKISDLTPLSKMKKIKTLDLIGNNIKDIQPLFTLSTMKQLYLANNQISDLNGIDRLNNVELLWIGNNKINNVESISKMSNLIELEIADSEIKDISPLSQLGNLQVLNLEENYISDISPLSTLTNLHEINLGANEISDVRPVEELGKRISIDIQRQKIFLNEASVDEELKIPVYNLKGEPLQNINVKSEGATLNNGFIKWNSPGEKIYEFKLDTNSTESKIRFNGTVIQNIVEKQKERANVILDKTLQQHINKENLGRENLNAPITKEDLLQVKKLEILKEKGNEIKDITGLEYMTNLENLTLEGVGLKNIDFISNLKRLNNVNVSHNQIEDITPLSSLKNLQWLNLTENRITDVTVLGSMLDLLSLKLAENEIRDVRPLIQLGQWVTIDVRRQKVILDDAEINKEVKIPVYDLEGEPIEKITLKSEGGTLTDEGIIWRTLGEKIYEFDLDADHYETGILYSGIVMQNIVEKLIPKEEVKEPTKEVEESKEEVKEPTKEVKEPTKEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEEAKEEVKEPTKEVEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 29373 - protein, 333 aa, Bacillus thuringiensis HD-789
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKKLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 29374 - protein, 458 aa, Bacillus thuringiensis HD-789; identical to SEQ ID NO: 26537

SEQ ID NO: 29375 - protein, 971 aa, Bacillus thuringiensis HD-789
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIINKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVYNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEGAENKAPVAVINGPYSGNVNEAISFKSDASKDEDGKITSYKWEFGDGTVSNEKNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 29376 - protein, 163 aa, Bacillus thuringiensis HD-789
MLKKVSQIVLIFGIAFSLSACTETKDSNESKQEDVQDKVYKIGETVDVDGLQVTIDSVKLGYPDYDEDKKKEEILGVIFKVENNSKKEIPFAFYEFEIIDKKGTRFKEYNNPDSFISKKLAPDEKIQDIMLFDVAKENTYIATYRPEFTRENRTIKFELKPNK

SEQ ID NO: 29377 - protein, 1093 aa, Bacillus thuringiensis HD-789; identical to SEQ ID NO: 27793

SEQ ID NO: 29378 - protein, 983 aa, Bacillus thuringiensis HD-789
MSRYNDSQNKFSKPCFPSSAGRIPNTPSIPITKAQLRTFRAIIIDLTKIIPKLFANPSPQNIEDLIDTLNLLSKFICSLDATSSLKAQGLAIIKNLITILRNPTFVASAVFIELQNLINYLLYITKLFRIDPCTLQELLKLIAALQTALVNSASFIQGPTGPTGPTGPAGATGATGPRGNTGATGPQGPQGNTGATGNTGAQGPAGATGATGPQGPQGNTGATGNTGAQGPAGATGATGPQGPQGNTGATGNTGAQGPAGATGATGSQGPQGNTGATGNTGAQGPAGATGATGPQGPQGNTGATGATGPQGVQGNTGATGATGPQGVQGNTGATGPQGVQGNTGATGATGATGPQGVQGNTGATGATGPQGVQGNTGATGPQGVQGNTGATGATGPQGVQGNTGATGATGPQGVQGNTGATGPQGLQGNTGATGPQGVQGNTGATGATGPQGVQGNTGATGATGPQGVQGNTGATGATGPQGLQGNTGATGATGPQGLQGNTGATGPQGLQGNTGATGATGPQGVQGNTGATGATGPQGLQGNTGATGPQGLQGNTGATGATGPQGLQGNTGATGPQGLQGNTGATGPQGVQGNTGATGATGPQGLQGNTGATGATGPQGLQGNTGATGPQGLQGNTGATGATGATGPQGVQGNTGATGATGATGATGPQGLQGNTGATGPQGVQGNTGATGPQGVQGNTGATGPQGVQGNTGATGATGPRGNTGATGPQGPQGNTGATGNTGAQGPAGATGATGPQGPQGNTGATGNTGAQGPAGATGATGPQGPQGNTGATGNTGAQGPAGATGATGSQGPQGNTGATGNTGAQGPAGATGATGPQGPQGNTGATGATGPQGVQGNTGATGATGPQGVQGPTGATGATGPQGVQGNTGATGATGPQGVQGNTGATGATGPQGVQGNTGATGATGPQGPQGNTGATGATGPQGVQGNTGATGATGPQGIQGPTGATGATGATGATGPQRSSR

SEQ ID NO: 29379 - protein, 525 aa, Bacillus thuringiensis HD-789
MAQSEFNQNLREQGQSRARVIILRVNNPGYNTNTLDIADIEDIIHLPQAIELANAFQSALVPTTSNFGEDTLRFDVERGLGIATHVYPRAINVNYVTRTLSQTNNQVQSMINKVIEELKSLLGINLANSVLQQLTTVITETFTNLYVQQQSAWLFWGRQTSSQTNYTYNIVFAIQNAQTGSFMKAIPIGFEISAYIARERLLFFNIQDYASYSVKIHAIQVMQPLIHESFQPLRGIFNIITSVNNRSAIQITEYYDENTHDYPVKLWDYNNIINQKWILVFNQTTRAYSIQNLIARYLVLTWDSTPGSNKVFASTNRWNDSQFWILESTADGSIFLTNMKDTQFVLEIENSSTTNGTNVIVNRKNNNAQQKFYLNKVNQEFQDGVYKIKTALNNSSVLQMSEDYFGYTSDYFVKLWTNNNNDINQKWIFEFDSTKSAYQIKSQRDPSLVLAWTWSVPTVKLPIPNNDDHLWFLQNAGSGTYYFVNMTDTRYVLEVASSSTTNGTILTINKRNGNLNQKFLLDMIN

SEQ ID NO: 29380 - protein, 176 aa, Bacillus thuringiensis HD-789
MYKKLGTIALTGALAFSLAACGETEVKEVSKNDAPKQAEKKDKKEKAESKIYKIGDTVEVNGLQLTFSSAKFVEPNEYVKAEKGKVLEIAFNAKNNGKKDIYFGTSELKIADTNGNQFKEYFGGENTFINENIAPGNQITNKMLFDVPEGDKFVGTFKPTFTFDEKSVKVEFEVAK

SEQ ID NO: 29381 - protein, 336 aa, Bacillus thuringiensis HD-789; identical to SEQ ID NO: 27010

SEQ ID NO: 29382 - protein, 582 aa, Bacillus thuringiensis HD-789
MFDNQNEHRKWEGIQVGALDSNLVGPTFPAIPSFTFPTGPTGPTGETGPTGPTGETGPTGPTGETGPTGETGPTGETGPTGETGPTGETGLTGPTGLTGPTGPTGPTGETGPTGPTGETGPTGETGPTGPTGPTGETGPTGETGSTGETGPTGPTGETGPTGETGPTGETGPTGETGSTGETGPTGVTGPTGVTGPTGETGTMVLTGVGDPTCAIGNLGDIYIDLSTGRTYYKLSQPVPPMVRAIPAPTGATIPVGSTQTYTTIDAALAVANNGDRLLLDAETFIITSTVTVNKSITIEGQGIGATTVITTLNTVISMFNVTVSNVIFRDMSIIQNFPSILSVESVISINNLLATGIYVDSCEISVCELGIAIKATEFQITNCNFTYAPAASPNNGYFYIIISSTSGQSIIDGNTFVSDSGNTRCRFIIITNITVNSGTLQGNLVISNNTQDNLSPATLRHLLDIEEFVGTNFGLFLLNNTTVNEGNVPVLLFNADFTIFKFIEVNGNSIQNTAGKGIIGIDSSSIGQTPIFSSGNTIANQSFTPGWASATIPPSFIVGYNTAVILEPPNLPLTSCYWLMLI

SEQ ID NO: 29383 - protein, 367 aa, Bacillus thuringiensis HD-789
MKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQYKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 29384 - protein, 188 aa, Bacillus thuringiensis HD-789
MKSRSYNEGTNNFVSKDTVPALTGYGFSPNVVAVITADKTETTSDLKITNRRISDQYNIEWVSSKWWGTNNKDTYNEFFTNHYKLDWKNHQVTLDNQKFLEEQMNSINSVNDKLNKGKGKLSLSMNGNQLKATSSNAGYGISYEDKNWGIFVNGEKVYTFNEKSTVGNISNDINKLNIKGPYIEIKQI

SEQ ID NO: 29385 - protein, 438 aa, Bacillus thuringiensis HD-789
MSKFKKNCHIPFPCAFPLPQIGSTGLTGATGPSGPTGATGPSGGPRGPTGPTGIQGSLGPTGPQGISGPQGIPGISGSIGPTGPSGIQGIQGIQGIPGIQGPIGPTGITGVTGIQGIPGIQGIPGIQGIQGIPGPTGPQGIPGIPGSVGPTGPSGAVGPTGPSGGPPGPTGPTGPSGGPPGPTGVTGPTGPSGSPGPTGLQGIQGIQGIPGPTGPQGSQGIQGIQGNPGPIGPIGPTGITGATGIQGIQGIQGNPGLIGPIGPTGPTGLQGIQGIQGIPGPTGLPGTAGATGPTGPTGLTVSGLSHYAYVFNTAAQVVALEAPILFNSHGRMTSGFTHTLGTSQLMVLNAGDYKISFSVSGVEPNQFTLFLNGAPVTSAVYGSGAGTQPNNGQTILALAAGDIITLNNHTSAAAVTLQTLAGGTQTNINASIVIEKLN

SEQ ID NO: 29386 - protein, 179 aa, Bacillus thuringiensis HD-789
MNKKLLTSLLCSTFLFGVSACSSHDTSAKNEQKTSKKTENNELNRKVPQKELPTNVDSSDVYMSMGSAESLDVLGTGEVKAQGVFKVLDIAVYNHKEEPITLDINNFKLIDGFGREYHISNEYQSVLKAANISTFKFNIVNPNESSEGNIVFNVPKNTQGLTLKINNDKLDKELQLKVE

SEQ ID NO: 29387 - protein, 431 aa, Bacillus thuringiensis HD-789; identical to SEQ ID NO: 26534

SEQ ID NO: 29388 - protein, 503 aa, Bacillus thuringiensis HD-789
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQPVTGVKEVTTKISEKDAIQKSMAYVGEASEQNLWAPTEKEFGYIVEEGMARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWTARGISTN

SEQ ID NO: 29389 - protein, 563 aa, Bacillus thuringiensis HD-789
MIEVVKGIREMKKIFSVLLVLFLTFSTWSSVLVKADSPSKGTLTIHKYEQEKDGAQGLEGDGSANQEVPKDAKPLKGVTFEVKKVASFEKISNDGKIVKEDVKPVMGATPTQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHVQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKFANN

SEQ ID NO: 29390 - protein, 263 aa, Bacillus thuringiensis HD-789; identical to SEQ ID NO: 29242

SEQ ID NO: 29391 - protein, 249 aa, Bacillus thuringiensis HD-789; identical to SEQ ID NO: 29252

SEQ ID NO: 29392 - protein, 945 aa, Bacillus thuringiensis IBL 200
MITFRIIYFGGDVKLKQNKRKRINAMIIAAALSLPFAVYSTPALAAVAIEANKTGQGLEDGTYDAVIKAYKDKTNEESMAAVYIKDPKLTIENGKKIVTATLSDSDFFQYLKTEDIHTPGVFHDVKVLSEDKKKNGTKVIQFEVGELGKTYNMQMHIYIPTMAYDNKYQVQFEVNAINLENNVPEKQKENKEEQQDENGNVILDKQLQKYINKYNLDRDNVDTPITKKDLLQIKTLSIYSGKGINGIAGLEYMTNLEKLTLRESNVTDISAISKLRSLKYVDLTSNSIESIHPIGQLENINMLFLRDNKISDLTPLSKMKKIKTLDLIGNNIKDIQPLFTLSTMKQLYLANNQISDLNGIDRLNNVELLWIGNNKINNVESISKMSNLIELEIADSEIKDISPLSQLGNLQVLNLEENYISDISPLSTLTNLHEINLGANEISDVRPVEELGKRISIDIQRQKIFLNEASVDEEIKIPVYSLKGEPLQNINVKSEGATLNNGFIKWNSPGEKIYEFKLDTNSTESKIRFNGTVIQNIVEKQKESQNVILDKTLQQHINKENLGRENLNAPITKEDLLQIKTVEILKEKEKGKEIKDITGLEYMTNLEKLTLEGVGLKNIEFISNLKQLNDVNVSHNQIEDTTPLSLLKNLQWLNLTDNRIKDVTVLGSMLDLLSLKLAENEIRDVRPLIQLGQWGTIDVRRQKVILDDAEINKEVTISVYHLEGEPIEKITLKSEGGTLTDEGIIWSTLGEKIYEFDLDADHYETGILYSGIVIQNIVETLIPKEEVKEPVKEVEETKEEVKEPVKEIEETKEEVKEPVKEVEKVKEPTKEVEEAKEEVKEPVKEVEETKEEVKEPVKEVEEAKEEVKESATGLDQEPKGNNQVVEKERRKADTLNKQHTNKPEEGKKSLPSTGGEASTSTLLSGITLVLSALSMFVFRKRLFKK

SEQ ID NO: 29393 - protein, 955 aa, Bacillus thuringiensis IBL 200
MLSISTMALSLGALQTHAAAEEKVPYNVLKTKPVGIEKPVDEVGHISKVDETLSFQERLKVGDFSQRPASITKKTAVKQVKESYSMAELNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTDEQDTVVSAYGKLISNASSDVETVQYASNILKQYNDNFTTYVNDRMKGQAIYDMMQGIDYDIQSYLVEARKEANETMWYGKVDGFINEINRIALLNKVTPENKWLVNNGIYFASRLGKFHSNPNKGLEVVTQAMHMYPRLSEPYFVAVEQITTNYNGKDYRGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNSPEEANRIGLNSTIKGSLIGGDHTDVYTFNVASTKDIDISVLNEYGIGMTWVLHHESDMQNYAAYGQANGNHIEAKFNAKPGKYYLYVYKYDNGDGTYKLSVK

SEQ ID NO: 29394 - protein, 333 aa, Bacillus thuringiensis IBL 200
MKGKLLKGVLSLGVGLGALYSGTAAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 29395 - protein, 179 aa, Bacillus thuringiensis IBL 200
MNKKLLISLLCSTFLFGVSACSSHDTSAKNEQKTSKKTENNELNRKNPQKELPTNVDSSDVYMSMGSAESLDVLGTGEVKAQGVFKVLDIAVYNRKEEPITLDINNFKLIDEFGKEYHISNEHQSVLKAANTSTFKFGIVNPDEHSEGNIVFDVPKNTQGLTLKINNDKLDKELQLKVE

SEQ ID NO: 29396 - protein, 183 aa, Bacillus thuringiensis IBL 200
MRKLSILLTFILVLVSVTAACTQDKTDSAVENVPIEEPSAKNVNEELINFEEKEDMSRLEQGILLVGESVKGGYYLTAVQSAYLNDSNDSIIVNVSVKNVRGQTIGLSELKYNLKDEKDGKAYKGKVLDQNPSDIQVKPNETVELKIAFEVPRTVDEYMFYIESSLDPLQTYWKIDKLQSQKN

SEQ ID NO: 29397 - protein, 345 aa, Bacillus thuringiensis IBL 200
MKRSKTYLKYLALSAVFASSAITLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASATPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKKIKKTEPPLR

SEQ ID NO: 29398 - protein, 503 aa, Bacillus thuringiensis IBL 200
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVTGVKEVTTKISEKDAIQKSMAYVGEASEQNLWAPTEKEFGYIVEEGMARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKIYPKDITNEVHDDGEIWAQGQYEMAQAFGRDVATKIILQSHWSLTPNSKFSDGAKAIKQADALLYGGQHAADIDRIWAARGISTN

SEQ ID NO: 29399 - protein, 122 aa, Bacillus thuringiensis IBL 200
MGSSVTFNTNGPITGTALSHITGTGNIIINTLGTYVAEFQLQASRENQCSFALNGTPIPGGRFGTGSPHTINQGTAAFTVTIVPSTLTLINNTSSAGTITLSNSDGGSLTNVSASISIFQVG

SEQ ID NO: 29400 - protein, 893 aa, Bacillus thuringiensis IBL 200
MGNKKEIAIVALTTGFVLTSVTPYGVGHAEEPGQMQVEIQEDSFRTGDLTQPSQKAPENVVKDALKENTDHALSPKQVSAETGVDYKVLQKRGSYDGTTLVRMQQIYEGKEVYGHQLTAHVDKKGIIKSISGASAQNLTQENLKKPINLSKEESKQYIYKKYGNDTKFISEPEVKAVIFVDENHGQASNAYQVTFAATTPNYVSGTYLVNAHNGEMLKDMVQESSLKISEEYVQSVKENKTSNFTSLTGTGKDDLGVTRTFGISKQTSGNYALADYTRGQGIETYDVNYRDITNEESYYPGILATSTSTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANNDELNMTSDFSELRLACLKVATNKYGMNSIEVQAVQNAFDAAKIIEKVKENEKTAENQAPELTVPFTITLRVGDTFDPMRNVKAVDKEDGDLTNKVKHKGDVDTSKPGTYIVEYLVVDSQGKTATATQTVIVEGNGEISDLEPKLTVPVEATIHVGDSFVPMEEVLAIDKEDGDLTAKITVDGEVDTTKAGTYVLTYTVTDSKGHEVTAKQTVTVKVREEVTNEKPILKVPATTSITEGDQFDPWVGVSATDKEDRDLTSKVAYEGTIDITKAGTYEILYSVRDSVGNEVNTIQKVLVKHKETSKANGLANKTIKNNISNNSNTDKKEYTYKELPKTGVSTTNSAAIGILMIITGTVLTLVRKFRKIQK

SEQ ID NO: 29401 - protein, 196 aa, Bacillus thuringiensis IBL 200
MIDTVLGTHFIDKKLQPSTKYSYTVKAIDAAGNVSKESTALTVKTTVETPDTEGPTQPKGLHSMGTTASSVDLMWSPSDDNIGVDHYDIYREIEGSMKKIATSNTTSYMDKNLIANTTYKYVVKAVDVAGNESVQSDIFTITTKTESASHEAWDAKKAYKKGDRVLHEGKVYEAVQSYQGNGDPNWIYALSLWKTV

SEQ ID NO: 29402 - protein, 878 aa, Bacillus thuringiensis IBL 200
MVKYSKISKWILGVGLVTITCNGLQIQAETKEKNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDITSDITNEAKLKDVKVTKNKSQFFNTFTLQGTYTGSAAKGEVEDWKVMNEATNDMLKRLSGKEWTGYKTLTAYFVNYRVNNAGQYEYDVVFSGVNPEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 29403 - protein, 380 aa, Bacillus thuringiensis IBL 200
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMVSVLGGVLLLTRNKIKTLFSK

SEQ ID NO: 29404 - protein, 55 aa, Bacillus thuringiensis IBL 200
METEKYLQVVEDEEIEQLVGGVGPGWIATLTKDCPANKPYACITIAGQTICKKCR

SEQ ID NO: 29405 - protein, 822 aa, Bacillus thuringiensis IBL 200
MLVKNQDKCSKFQAPIPFPPPGITGPTGPTGPTGALGGPTGPQGIQGVQGVQGENGPTGPTGLTGPQGSQGSQGPMGEQGPQGIQGVQGIQGERGPTGPTGIQGIQGIPGPIGPTGSTGIQGIQGMQGEVGPTGPTGIQGIQGVQGDNGPTGPTGNTGIQGVQGNLGSSGLQGITGIQGIQGPIGPTGPTGSQGIQGEQGPMGPQGGTGVQGLQGPQGEMGQVGPTGSQGIQGVQGVIGPTGATGLQGDPGPTGLTGSTGVTGPTGSATGPTGATGPTGPPGGPTGPTGPAGSPGGPTGPTGATGATGATGATGATGIQGVQGIQGPTGATGLTGLQGVQGPMGATGPTGDQGIQGPQGIQGVTGPTGPQGLQGLQGSIGPTGPTGPQGVQGAQGPIGPTGPQGVQGIQGEQGVRGATGPTGLQGLQGVQGPSGPTGPQGVQGVQGPSGITGPTGPQGIQGIQGPQGSIGPTGPQGIQGVQGPQGPTGPTGATGPQGIQGIQGPIGPTGPQGIQGIQGVQGPIGPTGPTGPQGLQGITGQAGPTGPTGATGPTGETGPQGPQGIQGPQGITGPTGATGPTGETGPQGLQGIQGPQGITGPTGATGPTGETGPQGLQGIQGPQGITGSTGATGQTGVTGATGPTGIQGIQGITGATGGTGVTGPTGATGPTGLTGATGSSAISTGGGYFFSTSTSTIAANANIPINSGSTVYGTGVSLTSATTVTVSTPGIYLVSYYFQGDATGGNEVVSVRLLLNGTQVTGSFIQNVTTSTVVLEPSISNTLLVNVASANSTFILQNGPLGVGHVTTIAGTITASLNVVRIL

SEQ ID NO: 29406 - protein, 811 aa, Bacillus thuringiensis IBL 200
MALPLPLIGATGPTGNSGPVGPTGGHEGPVGPTGMTGPTGATGPQGPQGIRGIQGSRGTTGAQGIQGAVGDTGEQGITGPTGLQGAQGLIGNQGPIGDIGVQGLEGTQGATGPAGSQGIQGTQGIQGEIGERGQTGAQGIQGERGVTGVPGITGPQGPQGVQGIQGEQGAIGIQGEDGPQGIQGITGEQGHQGDQGAQGVVGPTGSTGIQGPQGISGIKGITGVTGPQGPQGVQGIQGVSGSTGFQGAKGVRGITGATGPTGTQGSEGPPGGPTGTTGPIGPSSGVTGPSGPTGATGSTGVSGGIGPIGAQGVQGITGPTGPQGVRGAQGSQGVVGAVGVQGAQGPQGNPGITGPPGAEGSQGIQGTRGVTGPTGAEGPKGIQGIQGVIGPTGAQGMVGIQGIAGPAGVTGAEGVQGEQGIRGATGPAGAQGIQGVQGIQGETGAAGAQGPQGVQGIQGTTGLTGAQGLQGVQGIIGPTGAIGLQGPQGLQGITGPTGVQGVQGIQGVQGIIGPTGAQGIRGPQGNTGEVGITGPQGVQGAQGSQGPQGPQGNIGITGAMGETGATGATGSTGPQGLQGVQGITGIQGITGMTGDIGATGPQGIQGIQGIQGLQGPIGASGVTGASGSIGPVGAQGSQGQNGAVGPTGATGNVGSIGFSGIAGATGATGLPSGGGYFFSTATSTIAANALIPINSGSTIFGAGVSLTNATTITLSTPGIYLISYYFQGDAILGNETISVRLVLNGTQVAGSFILYVTKGNFILEPAISNTMVIEVTSPNSTLSLQNGPLAIGHVTTLAGVITASLNILQIV

SEQ ID NO: 29407 - protein, 198 aa, Bacillus thuringiensis IBL 200
MNEEYSILHGPALEPNLIGPTLPSIPPFTFPTGPTGITGPTGATGFTGIGITGPTGVTGPTGLGILPVFGTITSEVGIGFSAVVNTNVNFTIPGPASGTTLNPLNNSITIDTTGVYSVSFSIVFVIQAVSSSILNLTINDSIQFAIETRVGGGSGVRATSARTDLLSLNQGDVLRVRIREATGDIIYSNASLVVIKVD

SEQ ID NO: 29408 - protein, 463 aa, Bacillus thuringiensis IBL 200
MGGTKMKLKLTSKLERLKTSKKGIGACVLAAGMMAITMTPQSAYAHGFVEKPSSRAALCSQNYGALNLNCGNVMYEPQSLEAPKGFPDSGPIDGKIASAGGLFGGVLDQQTSNRWFKNTIKGGVNTFTWKYTAPHSTSKWHYYITKKGWDPNKPLTRAELEPIGTVKHDGSAASNNLTHTINVPTDRNGYHVILAVWDVADTSNAFYNVVDVNLVNNENPDTVAPSQPTELNASKVSANSVEITWKASTDNIGVKEYQVLRNGEVIDTVPGTTFIDKKLKADTEYTYTIKALDSAGNISKESEKLKVKTTHTIPDIEAPTQPKGLHSMGTTSTTVDLMWSPSEDNVGVDHYIVYRESAGVMNKIGTAANTSFMDKDLKANTSYKYVVTAVDLAGNESSRSDVLNVTTKSEDSAYEKWDARKAYTKGDRVVHEGKVYEAVQNHQGNGDSNWIFALSLWKPVLNK

SEQ ID NO: 29409 - protein, 250 aa, Bacillus thuringiensis IBL 200
MQIDLKAGVPHNYFDSTYASIKVQNTSGKVVYNKEFYGNKQQNAGTQKVSVKTGDFIELTHLEGGERATLINLDNNKRESLDKKVMYEVTKDGLKKVNQIVNPKPDTEAPTQPQGLYASNLTSNSVELKWNPSTDNIGVKEYQVLRDGQLIQTVQGTTFIDQNLTANKEYKYAVKAVDEAGNTSIQSEILPVKTKDQNVSYEKWDPKKAYIKGDKVEHQGTVYEAVQNHQGNGDPNWIFALSLWKPLTIK

SEQ ID NO: 29410 - protein, 310 aa, Bacillus thuringiensis IBL 200
MKEWLEMSAGQFNKIDPKKTEEQPLVNIGYPTYNFDILDGLKYEIDVTQPAKYDKDGKVVNANTNRIVNMTYEGKPVADDQEFIVATNNYRGSSQTFPGVSKGEVVYQSQDETRQIIVKYMQETPVINPTADQNWAFKPIVADKLNTTFDSSPNAQKYIKEDGKISYVGPSENQFAKYAIDITKKNDGGGNPTIPPKGDGENPTTPPTGGGENQTTPPTGNGENPTPPTEEGNNGNEPKQDGNNTGSGQTTTDDQNTKETTTTVSENKEAEKDERDLPKTGASIASTIGAGLAFVGAGLLMLFRRKKANR

SEQ ID NO: 29411 - protein, 287 aa, Bacillus thuringiensis IBL 200
MIALKKSNVKEVINMSSWSNNINGYCGCNNQNGVHVDSCCFSCDGTVPKVGPTGPTGATGATGGTGPTGATGVTGDTGPTGATGITGATGPTGATGITGATGATGPTGATGITGATGPTGATGATGATGATGATGITGATGATGDTGATGTSITATYAFANNTSGTAISVLLGGTNVPLPNNQNIGPGITVSGGNTVFTAANAGNYYISYTINITASLLVSSRITINGAPLAGTINSPALATTSFSATIITTLAAGSAISLQLFGLLAVATLSTTTPGAVLTIIRLS

SEQ ID NO: 29412 - protein, 117 aa, Bacillus thuringiensis IBL 200
MLGGTNIPLPNNQNIGPGITVSGGNTVFTVANAGNYYIAYTINLTAGLLVSSRITVNGSPLAGTINSPAVAAGSFSATIIANLPAGAAVSLQLFGVIALATLSTATPGATLTIIRLS

SEQ ID NO: 29413 - protein, 68 aa, Bacillus thuringiensis IBL 200
MVFSIKPTDSGAGQIQVFNPTPAVGPATVTWNSITTGNPVARGDAISLYITPGITASAVYSIFLITNI

SEQ ID NO: 29414 - protein, 431 aa, Bacillus thuringiensis IBL 200; identical to SEQ ID NO: 26534

SEQ ID NO: 29415 - protein, 462 aa, Bacillus thuringiensis IBL 200; identical to SEQ ID NO: 29260

SEQ ID NO: 29416 - protein, 775 aa, Bacillus thuringiensis IBL 200; identical to SEQ ID NO: 29259

SEQ ID NO: 29417 - protein, 659 aa, Bacillus thuringiensis IBL 200
MFNQRTRNGVKKILAITAASTVFSMFGSSISIIEAASAPGVYITPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDEKWTSWNTQSIEGQEPLNNNWDGGATSEYLWFKAGGDSRSTIGTGKTFTLNQPSQPEIGKLDYDVKSMYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYNKEVYGNTQQKAESKTVPVKVGNFIELTHLEGEERAILTNLDNNKRESFDKKVIYEVTKDGLKKVNQIVNPKPDTEAPTQPQGLYASNVASDSVELKWNPSTDNVGVKEYQVLRDGQLIQTVQETKFTDQNLTANKEYKYTVKAVDTAGNISVQSNILTVTTKSQNVTYEKWDPKKAYTKGDKVEYQGKFYEAVQSYQGNGDPTWIFALSLWQPFKLI

SEQ ID NO: 29418 - protein, 779 aa, Bacillus thuringiensis IBL 200
MKKKLTAIVTCTLLTPSLLSSNPSFIYAENQVKQVHSNEHKQVDRRGLIGYYFKENDFKSLALFAPTLNDFMYDQNSANDLLNKESQQYQSIRWIGLIKSKETGDFRFELSDDTNAIIEINGQIVSNKGNNKQEIHLEKDQLVPIKIEYQANKILKIEDIKNLNLIKKNHQNESYQIGLNELRKPDFNKKETNEFLKKAGGINLFKAGSLKDSDDSTDTDGDAIPDSWEENGYTIHKNVAVPWDNSFANKGYKKFVSNPYKSHTVSDPYSDYEKAAGDIPAGNAPETKNPLVAAFPSVNVGLEKVVLSKNKDMSHSVGSNSSENWSYTNTEGVNVDTGWDGLGPKIGISANYQHSKTVAKEWGYSTDDTSHINGAESAYLNANVRYQNVGTGAIYNVKPTTNFVLDDTTIGTIKAKENTTALSLPSGESYPKRGQHGIAINTMDDFNSRPIPLNKEQLQTYMSNRKPILLETTQTEGKYATINTEGQVVISGDWNGIAQEVENKTASILVDTGENVSEKRVAGKDYNNPEDLTPELTLKEALKLAYPNEIAEKGGLLFYNDKPIYEEAILSYVDQYTAKRIKEQIKDNSGRFKDVTKLYDVKLEPKMNFTLKLATLYDGAESGSSSINEDTISSPLGEWFGPKNSVTNLVGGNTGKRQYRLSKYENTYVGWLVLSPEIQNKLKKNYKYYISMFIKADKDIEPTIRINHGFNAIVNKKVKLSSDKYQRIDILVDNSESNLLDGILCTLGVSEEDKEIGTNYNGNIYIDDVAITEVSAIKQ

SEQ ID NO: 29419 - protein, 172 aa, Bacillus thuringiensis IBL 200; identical to SEQ ID NO: 28096

SEQ ID NO: 29420 - protein, 202 aa, Bacillus thuringiensis IBL 200
MKKAKEIAKCVAVASVIMSGSFSLQATSAFADSKGTVENLQNGGKVYNSFKTTYDMKQNIKNSIKVSFIEDPYADKKIAIVTTDGSNIDAKYTVNSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFFVI

SEQ ID NO: 29421 - protein, 1062 aa, Bacillus thuringiensis IBL 200
MTHEKYSMDWSYSNSLGKYIRTEFIKNSSGQIAYCLTLGLKSPNGEDLPEMGETDNVVYRVLLNGFPQKSIEQLGVANKNEAHYATQLAVWNALGQLDVNELKHENKNVEKAAKAIISNANNSEETQDVFMNVIPAEKQQAELKGEFFETNLYTVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDISKKLEGAEFELKDASGKVIGEYKTDKNGEINVKDLAYGKYSFVEKASPNGYVLVKEPIMFEIKEHGKIIELLAVNHLIKGELEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTKATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSITLDFTCNASALQGKEVVVFEELYQDNILVAIHAEIEDKGQTVKFKEVKPEQPKPEQPNSDENTPTPEQPNEQVKEQPQPKKEIQSQIGWLPQTGTNLTSWISMAAGALLLIVGGVIFLKRKNA

SEQ ID NO: 29422 - protein, 971 aa, Bacillus thuringiensis IBL 200
MKGYSKKMLVGVSFASLMLGSFQGGSLAEDTKGEQVSYRNVLKMEPVGVQLPVQELAHSSKVLESKSFEKRLQFSDLSQRPPEVKKESKQLAVAKTYTMAELNQLSNQQLVDLLVTIDWEQITGLFQFNTDSLAFYQNDDRVQAIIDKLKQQGQAYTKDDSKGIETLVEVLRSGFYLGFYNSELSKLNERNYHDKCLPALKAIANNSNFKLGTLEQNRVVSSYGKLIGNASSDVETITSAAKIFKQYNDNFSTLVDNVSAGNAIYDIMQGVDYDIQSYLYDTRKAPKDTVWYQKIDSYINELSRFALMGTITAKNGWLINNGIYYTGRLGTFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPVERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHSSKPVSDIAAEITTEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAFINGPYSGNVNEAISFKSDGSKDEDGKITSYKWEFGDGTVSNEQNPTHVYTKEGAYTAKLTVTDDKGATNTATATVTVQKKEDNSVEKEPNNSFQTANKLQLNQVLRASLGNGDTSDFFEINVETAKNLQINVTNENNIGMNWILYSEADLNNYVTYAQQQGNKLVGSYYTYPGKYYLHVYQYGGGTGNYTVEVK

SEQ ID NO: 29423 - protein, 667 aa, Bacillus thuringiensis IBL 200
MIIKKHQFRTLAKTAVALTMIIPTSQAISQPFAYAQENITKSQQQVAPFWNKNKDYPGESYVTYEGKIYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNIPGLGADLAAAITDVNKLKDAYKSVINTLHLTHMDFDIEGVLVAHPESIERRSKAIALLQKELKAEGKDVKIGYTLPVMPYGLTNDGLNVIQSAIKHDVDLNSVNIMTMDYGQQTQQMGQAAIDAINSLHGQLTNLYKGTIKDSDIWKMIAVTPMIGKNDTQNETFTLNNAKELFQFAKEKGIGEISMWSVYRDKKATESWQIGQATGDASGLPDVDDGAFSKLFSAFNSSTEIDVIAPTAPSNLRSVSKTTTTVELQWEASTDNIGVKEYEVYRDGKKVGTTKTTRYEDAGLQANTKYNYTIKATDAAGNKSKSSNEVSVTTKEENPEQIAPTAPTGLQASETTTNSVHLIWEESISNVGIKEYEIYRNGTKIATSPSTYYTDENLLASTEYRYMVKAIDTQGKVSVASNEIKITTKDTPSSEYKAWDSYAAYKKGDRVEHQGKIYEAVQSYQGYGDPNWIFSLALWKVIK

SEQ ID NO: 29424 - protein, 320 aa, Bacillus thuringiensis IBL 200
MWNCFTLNLLTAHADTKIESIVDIGENGQNAKVYNNFSTLFDEQAKIKTSLLVSIIDDPYSNKQIAVIKTDGSNISAYKSVEGLTDEYGHEAGYMSAVLKWASSYNIGMELTNENSQFYKVSPINTIDTKTITSSIGYKIGGEIKVSDKADGGGSVGMNWSTSTSYDQPDYKTVLETDTANKVQWRIPVISTMNQGYGPYNRESDDSIYRNQLFMKSRNAATWAKDNFISSDEMPALASYGFSPGMIAVVIADKSEDISTFKITYTRNSDDYRMDWTSFFNGVHGSGAGWWVGGNIKDVSKGISVHNYSVDWKNHRLIEN

SEQ ID NO: 29425 - protein, 52 aa, Bacillus thuringiensis IBL 200
MFATGITPSLEIFAEEQAQQQKVYEAVQNHQGNGDSNWIFALSLWKPLILNF

SEQ ID NO: 29426 - protein, 772 aa, Bacillus thuringiensis IBL 200
MGIILYKGESCSSQKSKTKKGEIILKRISSLLLTMPIILGSIATIPHTKVSAETMSFNQETFTLETLNQQTDQAIANGNFEAHLNNLTAYLNGNIGGITEENLKKKLADPAFAAALAQWQFISQTGAVTMATFAKKDADHQKFLGWAMKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLINYVTHNKDGVSIHAGNDAFYGLGWNLSSIYKFGGVCGNISKFGTQVSQAFGVAAMPVGQPGHCALIWNNKPSSWNLGNDISGWSQSSRHDATVIPWSDNSPTNQVPYMLLFENAERDPVKLDQSERLRWLAKAMTSKDNKIAIYKISTNILPINFLVWEDYVSLMLQNPNVTDAEWKELNNNIISVFANEPRPMMDLLTQIKNHVPNTDDILEGDQFAWSLKGIGDFEFAKVNLNKLTEEMQIDLKAGVPHNYFDSTYASIKVQNTSGKVVYNKEINGKKQQNAEQAKVSVKVGEFIEFTHLEGANRAIIKNMEKNIQESFGNKAVYEITKEGLKKVDNIVNPKPDTEAPTQPQGLYASNLTSNSVELKWNPSTDNVGIKEYQVLRDGQLIQTVQGTTFTDQNLTANKDYKYAVKAVDAAGNTSIQSNILPVKTKDQNVSYEKWDPKKAYTKGDKVEHQGKVYEAVQNHQGNGDPNWIFALALWNPLT

SEQ ID NO: 29427 - protein, 136 aa, Bacillus thuringiensis IBL 200
MTPVFGMLNTDSVTDIPTVANTNINFTVIEPLNGVILSTADNSITVGSAGVYAVTFSTGVSVFGEDSGILIMNFTINDTVNFLSQIRIDLDQGSRIMASKTVLLSLNQGDVLRVLIRLSAGPVFIGEASFVVEKVG

SEQ ID NO: 29428 - protein, 188 aa, Bacillus thuringiensis IBL 200
MKSRSYNEGKNNFVSKDTVPALTGYGFSPNVVAVITADKTETTSDLKITNRRISDQYNIEWVSSKWWGTNNKDTYNEFFTNHYKLDWKNHQVTLDNQKALEEQMNSINSVNDKLNKGKGKLSLSMNGNQLKATSSNAGYGISYEDKNWGIFVNGEKVYTFNEKSTVGNISNDINKLNIKGPYIEIKQI

SEQ ID NO: 29429 - protein, 163 aa, Bacillus thuringiensis IBL 4222; identical to SEQ ID NO: 29376

SEQ ID NO: 29430 - protein, 92 aa, Bacillus thuringiensis IBL 4222
MEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 29431 - protein, 949 aa, Bacillus thuringiensis IBL 4222
MALSLGALQTHAVAEEKVPYNVLKTKPVGIEKPVDEVGHVSKVDETLSFQERLKVGDFSQRPASITKKTAVKQVKESYSMADLNKMNNQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGNGTYELSVK

SEQ ID NO: 29432 - protein, 172 aa, Bacillus thuringiensis IBL 4222
MGTIALTGALAFSLAACGETEVKEVSKNDAPKQAEKKDKKEKAESKIYKIGDTVEVNGLQLTFSSAKFVEPNEYVKAEKGKVLEIAFNAKNNGKKDIYFGTSELKIADTNGNQFKEYFGGENTFINENIAPGNQITNKMLFDVPEGDKFVGTFKPTFTFDEKSVKVEFEVAK

SEQ ID NO: 29433 - protein, 333 aa, Bacillus thuringiensis IBL 4222; identical to SEQ ID NO: 29373

SEQ ID NO: 29434 - protein, 179 aa, Bacillus thuringiensis IBL 4222; identical to SEQ ID NO: 29386

SEQ ID NO: 29435 - protein, 667 aa, Bacillus thuringiensis IBL 4222
MIRKKHPFCTLAKTAVALTMIIPTSQAISHTFAYAQENIAKSQQQVAPFWNKNKDYPGESYVTYEGKIYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNIPGLGADLAAAITDVNKLKDAYKSVINTLHLTHMDFDIEGGLVAHPESIERRSKAIALLQKELKAEGKDVKIGYTLPVMPYGLTNDGLNVIQSAIKHDVDLNSVNIMTMDYGQQNQQMGQAAIDAINSLHGQLTNLYKGSIKDSDIWKMIAVTPMIGKNDTQNETFTLNNAKELFQFAKEKGIGEISMWSVYRDKKATESWQIGQATGDASGLPDVEDGAFSKLFSAFNSSTEIDVIAPTAPSNLRSVSKTTTTVELQWEASTDNIGVKEYEVYRDGKKVGTTKTTRYEDAGLQANTKYNYTIKATDAAGNKSKSSNEVSVTTKEENPEQIAPTAPTGLQASETTTNSVHLIWEESISNVGIKEYEIYRNGTKIATSPSTYYTDENLLASTEYRYMVKAIDTQGKVSVASNEIKITTKDTPSSEYKAWDSYAAYKKGDRVEHQGKIYEAVQSYQGYGDPNWIFSLALWKVIK

SEQ ID NO: 29436 - protein, 336 aa, Bacillus thuringiensis IBL 4222; identical to SEQ ID NO: 27010

SEQ ID NO: 29437 - protein, 503 aa, Bacillus thuringiensis IBL 4222; identical to SEQ ID NO: 29388

SEQ ID NO: 29438 - protein, 893 aa, Bacillus thuringiensis IBL 4222; identical to SEQ ID NO: 29368

SEQ ID NO: 29439 - protein, 563 aa, Bacillus thuringiensis IBL 4222; identical to SEQ ID NO: 29389

SEQ ID NO: 29440 - protein, 387 aa, Bacillus thuringiensis IBL 4222
MYEPQSLEAPKGFPQGGPVDGQVASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 29441 - protein, 377 aa, Bacillus thuringiensis IBL 4222
MHMKEKRYKNMKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQYKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 29442 - protein, 572 aa, Bacillus thuringiensis IBL 4222
MALPLPLIGATGPTGNSGPVGPTGGHEGPVGPTGMTGPTGATGPQGPQGIRGIQGSRGTTGAQGIQGAVGDTGEQGITGPTGLQGAQGLIGNQGPIGDIGVQGLEGTQGATGPAGSQGIQGIQGIQGEVGERGQTGAQGIQGERGVTGVPGVTGSQGPQGVQGIQGEQGATGIQGEDGAQGIQGITGEQGHQGDQGAQGVVGPTGSTGIQGPQGISGIKGITGVTGPQGPQGVQGIQGVSGSTGFQGAKGVRGITGATGPQGIQGIQGVQGPIGPTGPTGPQGLQGITGQAGPTGPIGATGPTGETGPQGPQGIQGSQGEMGPTGATGPTGETGPQGLQGIQGPQGITGPTGATGPTGETGPQGLQGIQGLQGITGSTGATGQTGVTGATGPTGIQGIQGITGATGGTGVTGPTGATGPTGLTGATGSSAISTGGGYFFSTSTSTIAASANIPINSGSTVYGTGVSLTSATTVTVSTPGIYLVSYYFQGDATGGNEVVSVRLLLNRTQVTGSFIQNVTTSTVVLEPSISNTLLVNVASANSTFILQNGPLGVGHVTTIAGTITASLNVVRIL

SEQ ID NO: 29443 - protein, 181 aa, Bacillus thuringiensis IBL 4222
MESFIVRFNMLDEIACITNTIEKDTEYTPVVSIVMELSTGFRVVPLTGPGMVKLTFVLTTAEKPIPTSEVIVPNTGRIPKPVAPVGPVIPIPVGPVTPVGPVIPIPAGPVTPVGPVIPIPVGPVTPVGPVIPIPVKPVAPVGPVIPVGPVGKVNGGIDGSVGPIKFGSRAGPCKVLYSSFI

SEQ ID NO: 29444 - protein, 39 aa, Bacillus thuringiensis IBL 4222
MASLIRNRRTSPWFKGNRSVLADVALTPEAPPTRVSIAN

SEQ ID NO: 29445 - protein, 263 aa, Bacillus thuringiensis IBL 4222
MIALKRSNVKEVINMSSWSNNINGYCGCNNQNGVHVDSCCFSCDGTVPKVGPTGPTGATGITGATGSTGATGVTGDTGATGATGVTGDTGATGATGITGATGPTGATGVTGDTGATGATGPTGATGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 29446 - protein, 470 aa, Bacillus thuringiensis IBL 4222
MKNRDNKGKQQSNFRIPPELIGPTFPPVPTGFTGIGITGPTGPQGPTGPQGPRGFQGPMGEMGPTGPQGVQGIQGPVGPIGATGPEGQQGAQGLRGPQGETGATGPQGVQGLQGPIGPTGATGAQGIQGIQGLQGPIGATGPEGPQGIQGVQGLPGATGPQGIQGAQGIQGTQGPSGNTGATGATGQGLTGPTGITGPTGITGPSGGPPGPTGPTGATGPGGGPSGSTGATGATGDTGATGSTGVTGATGAQGPQGVQGIQGPTGATGATGATGPQGIQGPQGIQGPTGATGATGSQGPTGNTGPTGSQGIQGPTGPTGAGATGATGATGATGVSTTATYAFANNTSGSIISVLLGGTNIPLPNNQNIGPGITVSGGNTVFTVANAGNYYIAYTINLTAGLLVSSRITVNGSPLAGTINSPAVAAGSFSATIIANLPAGAAVSLQLFGVIALATLSTATPGATLTIIRLS

SEQ ID NO: 29447 - protein, 431 aa, Bacillus thuringiensis IBL 4222; identical to SEQ ID NO: 26534

SEQ ID NO: 29448 - protein, 188 aa, Bacillus thuringiensis IBL 4222; identical to SEQ ID NO: 29384

SEQ ID NO: 29449 - protein, 251 aa, Bacillus thuringiensis IBL 4222
MQIDLRAGVPHNYFDSTYASIKVQNTSGKVVYNKEVYGNKQQNAEQAKFQVKVGDFIEFTHLEGADRAIITNMEKNIQESFGNKAVYEITKEGLKKVDKIINPKPDTEAPTQPQGLYASNVTSTSVELKWNSSTDNVGVKEYQVLRDGQLIQTVQGTTFTDQNLTANKEYKYAVKAVDAAGNTSIQSNILPVKTKDQNVSYEKWNPKKAYTKGDKVEHQGTVYEAVQNHQGNGDPNWIFALSLWKPLILNF

SEQ ID NO: 29450 - protein, 763 aa, Bacillus thuringiensis IBL 4222
MQQSKVKNKKREGIILKRISSLLLTMPIILGSIATIPHTKVSAETMSFNQETFTLETLNQQTDQAIANGNFEAHLNNLTAYLNGNVGGMTEENLKKKLADPVFAAALAQWQFISQTGAATMATFAKKDADHQNFLGWAMKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLVNYVTHNKDGVSIHAGNDAFYGLGWNLSSIYRFGGVCGNISKFGTQVSQAFGVAAMPVGQPGHCALIWNNKPSSWNLGNDISGWGGSSRHDATVIPWSDNSPTNQVPYMLLFENAERDPVKLDQSERLRWLAKAMTSADNKIAIYKISTNILPINFLVWEDYVSLMLQNPNVTDAEWRELNNSIISAFANEQRPLKDLLTQIKSHVPNADDILEGKQFSWSLKGIGDFEFAKVNLNKSTEEMQIDLKAGVPHNYFDSTYASIKVQNTSGKVVYNKEVNGKNQQNAEQAKVSVKVGDFIEFTHLEGANRAIIKNMEKNIQESFGNKAVYEITKEGLKKVDNIVNPKPDTEAPTQPQGLYASNLTSNSVELKWNPSTDNVGIKEYQVLRDGQLIQTVQGTTFTDQNLTANKEYKYAVKAVDAAGNTSIQSNILLVKTKDQNVSYEKWDSRKAYTKGDKVEHQGKVYEAVQNHQGNGDPNWIFALALWNPLT

SEQ ID NO: 29451 - protein, 659 aa, Bacillus thuringiensis IBL 4222
MFNQRTRNGVKKILAITAASTVFSMFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSMYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYSKEVYGNTQQKAESKTVPVKVGNFIELTHLEGEERAILTNLDNNKRESFDKKVIYEVTKDGLKKVNQIVIPKPDTEAPTQPLGLYASDVTTNSVELKWNPSTDNVGVKEYQVLRDGQLIQTVQETQFTDQNLTANKEYKYTVKAVDAAGNISVQSDILPVTTKSQNVTYEKWDPKKAYTKGDKVEYQGKFYEAVQSYQGNGDPTWIFALSLWQPFKMI

SEQ ID NO: 29452 - protein, 183 aa, Bacillus thuringiensis IBL 4222; identical to SEQ ID NO: 26531

SEQ ID NO: 29453 - protein, 202 aa, Bacillus thuringiensis IBL 4222; identical to SEQ ID NO: 29370

SEQ ID NO: 29454 - protein, 1055 aa, Bacillus thuringiensis IBL 4222
MNWSYSNSLGKHIRTEMIKNSSGQIAYCLTLGLKSPNGEDLPEMGKTDNVVYRVLLNGFPQKSVQQLGVANQNEAHYATQLAVWNALGQLDVNELKHENKNVEKAAKAIISNANNSEETQDVFMNVIPAEKQKAELKGEFFETNLYSVQTNAKGGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGIAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDVSKKLEGAEFELKDASGKVIGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 29455 - protein, 971 aa, Bacillus thuringiensis IBL 4222; identical to SEQ ID NO: 29375

SEQ ID NO: 29456 - protein, 525 aa, Bacillus thuringiensis IBL 4222; identical to SEQ ID NO: 29379

SEQ ID NO: 29457 - protein, 250 aa, Bacillus thuringiensis IBL 4222
MQIDLKAGVPHNYFDSTYASIKVQNTSGKVVYNKEIYGNKQQNAESQKVSVKVGDYIELTHLEGVHRATITNVEKSIQESFGNKVVYEITKEGLKKVDKIVNPEPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQSHQGNGDPNWIFALSLWKPITIK

SEQ ID NO: 29458 - protein, 249 aa, Bacillus thuringiensis IBL 4222; identical to SEQ ID NO: 29252

SEQ ID NO: 29459 - protein, 450 aa, Bacillus thuringiensis IBL 4222
MERLRTSKKGIGACVLAAGMTAITMAPQSAYAHGFVEKPSSRAALCSQNYGVLNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHTIPDIEAPTQPKGLHSMGTTSTTVDLMWSPSEDNVGVDHYIVYRESAGVMNKIGTAANTSFMDKDLKANTSYNYVVTAVDLAGNESSRSDVLNVTTKSENSAYEKWDARKAYTKGDRVVHEGKVYEAVQNHQGNGDSNWIFALSLWKPVLNK

SEQ ID NO: 29460 - protein, 263 aa, Bacillus thuringiensis IBL 4222; identical to SEQ ID NO: 29242

SEQ ID NO: 29461 - protein, 457 aa, Bacillus thuringiensis MC28
MNKGRIGPENIGPTFPVLPPIYVPTGSTGPTGATGVTGATGVTGVTGATGVTGATGVTGVTGVTGVTGVTGPTGATGVTGATGVTGVTGATGATGSTGVTGATGVTGATGATGVTGATGVTGATGVTGVTGVTGVTGPTGATGVTGPTGVTGVTGATGVTGVTGATGATGVTGVTGVTGVTGVTGPTGATGVTGPTGVTGVTGATGVTGVTGATGVTGATGATGATGVTGATGATGVTGATGATGVTGVTGVTGVTGPTGATGVTGPTGVTGVTGATGVTGATGATGVTGVTGVTGATGATGVTGVTGVTGVTGVTGVTGPTGATGVTGPTGVTGVTGATGATGSTGVTGVTGATGVTGITGATGPTGGIGPITTTNLLYYTFSDGEKLIYTNADGIAQYGTTNILSPSEVSYINLFINGILQPQPFYEVSTGKLTLLDNQPPSQGSSIILQFIIIN

SEQ ID NO: 29462 - protein, 458 aa, Bacillus thuringiensis MC28
MNLKLISKLERLRKSKKGIGAFVLAAGVTAITMVPQSAYAHGFVEKPSSRAALCSQNYGALNLNCGNVMYEPQSLEAPKGFPDGGPIDGKIASAGGLFGGTLDQQTSSRWFKNTIKGGANTFTWKYTAAHSTSKWHYYITKKGWDPNKPLTRAELEPIGTVKHDGSAASNNLTHTIIVPTDRNGYHVILAVWDVADTSNAFYNVIDVNLVNNETPDTVAPSQPTGLNASKVAANSVEITWKASTDNIGVKEYQVLRNGEVIDTVPGTTFIDKKLKADTEYTYTIKALDTAGNISKESEKLKVKTTNETPDIEAPTQPKGLHSMGTTATTVDLMWSPSEDNVGVDHYIVYRESAGVMNKIGTADNTSFMDKNLKANTSYKYVVTAVDLAGNESSRSDVLNVTTKSEDSTYEKWDARKAYTKGDRVVYEGKVYEAVQDHQGNGDSNWIFALSLWKPVMNK

SEQ ID NO: 29463 - protein, 444 aa, Bacillus thuringiensis MC28
MKMNKKSLGAVALTAGIIGTTLIPQNAYAHGFVEKPGSRSALCSPTYGALNVNCGSVMYEPQSLEAPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTAKTTVEAPDTEAPTQPKGLHSMGTTASSVDLMWSPSDDNVGVDHYDIYREIEGTMKKIATSNTTSYMDNNLLANKTYKYVVKAVDVAGNESVQSDIFTITTKTESVSYGEWDAKKAYKKGDRVLYEGKVYEAVQNHQGNGDPNWIYALSLWSAV

SEQ ID NO: 29464 - protein, 128 aa, Bacillus thuringiensis MC28
MYAFNSATVSLALGINDPVPFNTVGSQFGTAISQLDADTFIISETGFYKITVIAYTALVSVLGSLAIQVNGVNVPGAGTSLISVGAPLVIQAITQITITPSMVEAVVTGLGLSLALGTSASIIIEKIA

SEQ ID NO: 29465 - protein, 170 aa, Bacillus thuringiensis MC28
MEEVLVGLNGLTGAQGPAGSQGPAGSQGATGATGPAGTPIPVPIASTGNSNAQTISPGTNIQFNQVFELNNITFNDTADTLTVLETGVYDINFSASTTFPGSSPFGFGISFNGQPPTRNFSTNVIGSAVSFSTIVTLQAGTTIAVQPTANTISIPNTGDTTATLSVFRIY

SEQ ID NO: 29466 - protein, 179 aa, Bacillus thuringiensis MC28
MFKKIGTVTLAGALAFSLSACDEKKEAAKTVSNNTKEEQGSAKKENTKNEDTREYSVEKTTQIRDQKLTVHKVQIAQVAEYDKLEKGNEFVIVHVTVENIGNQKVRINPLDFYLERGEGSIVDHTFSTSNKNIFKIKDVDPNGKLTGAITFEAKKGDSNLQLIYRPDVMSKEEVKVELK

SEQ ID NO: 29467 - protein, 502 aa, Bacillus thuringiensis MC28
MLNKKMVAMAMTVPLVMGTISTVSALEKKQVKVEAYSPQKKAVEYLKGNANQYGLKPDLSDLQYISTTETSVASYVRFQQVVNGAPVFSKQITVTLNGEGKGVLAVSDYQPVTGVKEVSTKISEKDAIQKSMAYVGEASEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFRDGAKAIKQADSLLYGGQHAAEIDRIWAARGISTN

SEQ ID NO: 29468 - protein, 723 aa, Bacillus thuringiensis MC28
MSSWLNNTNGYCGCNNQNGVHVDSCCFSCDGTVPKLGPTGPTGPTGPTGPTGPTGPTGSTGPTGPTGPTGPTGPTGPTGPTGSTGATGSTGSTGSTGSTGATGATGATGATGATGATGATGATGATGATGATGATGATGATGATGATGATGATGATGATGATGATGPTGATGATGATGATGATGATGATGATGPTGPTGPTGPTGPTGPTGSTGATGSTGATGPTGATGDTGPTGATGPTGATGDTGPTGATGPTGATGDTGPTGATGPTGATGDTGPTGATGPTGVTGSTGATGPTGATGITGATGPTGATGITGATGPTGATGITGATGPTGATGSTGATGPTGATGITGATGPTGATGSTGATGPTGATGITGATGITGATGITGATGITGATGITGATGITGATGITGATGITGATGITGATGITGATGITGATGITGATGITGATGITGATGITGATGITGATGITGATGITGATGPTGATGITGATGTTGATGITGATGITGATGTTGATGTTGATGITGATGPTGATGTTGATGITGATGITGATGITGATGPTGATGITGATGPTGATGDTGPTGATGTSITATYAFANNTSGTAISVLLGGTNVPLPNNQNIGPGITVSGGNTVFTAANAGNYYISYSINITASLLVSSRITINGAPLAGTINSPAVATTSFSATIITTLAAGSAISLQLFGLLAVATLSTTTPGAVLTIIRLS

SEQ ID NO: 29469 - protein, 950 aa, Bacillus thuringiensis MC28
MKERDKQNSLNSNFRISPNLIGPTFPPVPTGFTGIGITGPTGPQGPTGPQGPRGFQGTMGEMGPTGPQGVQGIQGPVGPIGATGPEGQQGPQGLRGPQGETGATGLQGVQGLQGPIGPTGPTGVQGIQGVQGLQGPIGATGPEGSQGIQGVQGIPGATGPQGIQGVQGIQGTEGPSGSTGTTGATGQGITGPTGITGPTGITGPSGGPPGPTGPTGATGPGGGPSGSTGVTGPTGATGNTGATGQGLTGPTGSTGETGAQGLQGIQGIQGPIGPTGPEGPQGIQGIPGPTGVTGEQGIQGVQGIQGIMGATGDQGPQGIQGAIGPQGVTGATGDQGPQGIQGVPGPSGATGPQGVQGIQGPMGEIGPTGPEGPEGLQGPQGIQGVPGPVGATGPEGPQGIQGIQGPVGATGPQGPQGIQGIQGVQGITGVTGVQGETGIQGIQGEIGATGPEGPQGVQGAQGAIGPTGPMGPQGVQGIQGIQGPTGAQGVQGPQGIQGIQGPTGVTGDTGATGATGEGTTGPTGTTGPTGVTGPSGGPAGPTGPTGPSGPTGVTGPSGGPPGPTGATGSTGATGDTGATGPAGVTGATGETGATGVTGLQGPQGIQGVQGEIGPTGPQGIQGPQGIQGVTGATGDQGPQGIQGPQGIQGPTGPQGIQGAQGPQGIQGATGATGAQGPQGIQGIQGIQGPTGPQGPTGIQGVQGEIGPTGPQGVQGLQGPQGPTGDTGATGAQGPQGIQGPTGITGATGATGLQGIQGAQGPQGIQGPTGATGATGSQGSTGDTGPTGSQGIQGPTGPTGAGATGATGATGATGVSTTATYAFANNTSGSVISVLLGGTNIPLPNNQNIGPGITVSGGNTVFTVANAGNYYIAYTINLTAGLLVSSRITVNGSPLAGTINSPAVATGSFSATIIANLPAGAAVSLQLFGVVALATLSTATPGATLTIIRLS

SEQ ID NO: 29470 - protein, 553 aa, Bacillus thuringiensis MC28
MKKILSVLLVVFLTFSAWSSVLVKAASSTKGSLTIHKYEQEKDGTTGVEGDGSANQEVPTNAKPLKGVTFEVIRVASFEKISNDGKIVKEDVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKELVTDANGHIRVQGLEYGEYYFQETKAPKGYVIDPTKREFFIKNSGTINEDGTITSGTVVKVEVKNYEEPTIDKKINGNLEALPINPLTNYNYDIKTLIPEDIKEYKKYVVTDTLDNRLVIQGKPIVKIDGAEVNASIVDVTVEGQKVTATVKDFTKLDGKKEFHLQIKSQVKEGIPSSSEILNTAKIDFTNKNDVIGDKESKPVVVVPTTGIIELSKIDGDDKKELKGAEFVLKDKKGKIVVVAGKEVIGVSDENGVIKWANIPYGDYQIFETKAPTYTKEDGTTASYQLLKDPIDVKVSENNQTVKLTIENNKSGWILPVTGGIGTTLFTVLGLMLMVTATFVFFRKKFANK

SEQ ID NO: 29471 - protein, 890 aa, Bacillus thuringiensis MC28
MKNKKEIAIVALTTGLALTAVAPYGIGHAEETDQLQVQMQEESFRSGELTQPSQKTPENVVKDALKEKTEQALSPKQVNGETGVDYKVFQKRGSYDGTTLVRMQQTYEGKEVYGHQLTAHVDNKGVIKSVSGDSAQNLKQEDLKKPIKLSKEEAKQYIYTKYGSDIKFISEPEVKEVIFVDENNGQASNAYQVTFAAATPSYVSGTYLVNADNGEMLKNMVQESGLKVSEEHVEPLKESRKNNFVSLTGTGKDDLGITRTFGIYEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKAFDIVGHEFTHAVTSSESNLEFFGESGAINEALSDIMGTAIEKYINNGEFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGTVKENEKTAENQVPELTVPSTITLRVGDTFDPMRNVTAADKEDGDLTNRVQHKGDVDTSKPGKYIVNYLVVDSQGGNATDTQTVIVEKNEEILDIEPKLTAPIGVTINVGDSFVPMTEVLAIDKEDGDLTSKVKVDGKVDTSKAGTYVLTYTVTDSKGHEVTAKQTVTVKVREEVKNDNPILKVPATTTINENDQFHPMVGVSATNKKNDDLTSKVKVDGKVDTSKADTYEIIYSVRDSVGNEVKAIQKVLVKDKDTSKANGLANNSNISNNSNSDKKEYTYKELPKTGASTTNSAVMGMLMVIAGTVLTLIRKFRKTHK

SEQ ID NO: 29472 - protein, 378 aa, Bacillus thuringiensis MC28
MLVLFVLFVLFVLFVLFVLFVLFVLFVLFVLFILFVLFVLFVLFVLFVLFVLFVLFVLFVLFVLFVLFVLFVLFVLFVLFVLFVLFVLFVLFVLFILFVLFVLFVLFVLFVVFILFILVYLVYLVCPVCLVCLVCLVCPVCPVCPVCPVCLVCPVCLVYPACPVCLVYPVCLVCLVCPVCPVCPVCPVCPVCPVCPVCPVCPVCPVCPVCPVCPVCPVCPVYPVCPVCPVYPVCPVCPVCPVCPVCPVCPVCPVCPVCPVCPVCPVCPVCPVCPVCPVCPVCPVCPVCPVCPVCPVCPVCPVCPVCPVCPVCPVCPVCPVCLVCPVCLVCLVCRACPAYFLFPAVLVQICQSLIQSARLFYSLLFYKSLFCFVFHVLA

SEQ ID NO: 29473 - protein, 738 aa, Bacillus thuringiensis MC28
MKQLKPAISVLGSVSMALTLASPALADVKQPNPGGTVEIFKENANVKKEDKNFTIGSDGEIGSLITQNIEMANNDWDKDGISNDLEMNGYKIEFNSQTGKNEAKVWDPEKDKGKPKFISNPMNANTDGDPFTDMYEVENYNNDSDTNFNPIVANMPNLQIGVKRIEVIPIATITDNNGGSVSRGWEKSVSTQHSFNVGFSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADKPVLSYNEVFQHVNIDKKKVNHIVNKAKSTNNVSVVAANNGTDALNDLKAGQGDRGYLHKDSVHGAFAKLQQPTLVEGSYDSVTQKIRATILPGLFGVSKEIPTTYSKKWNAPSQTVILVKRENGFTYESRENIHPIKSEIAAHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 29474 - protein, 214 aa, Bacillus thuringiensis MC28
MSPVGPVGPVVPVSPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVGPVAPVGPVGPVGPVGPVGPVGPVGPVGSVNGGIGGKVGPTRLGSNALADNDSSGFKPSE

SEQ ID NO: 29475 - protein, 279 aa, Bacillus thuringiensis MC28
MKGWFFLRNNYNNANNINPRKYHGYEESHGYEESHGYEESHGYEESHGYEEPPRYDKYPGYTTMPQRKCPPPCQCQCPPPCQCPPPCPPQCPPGPPGEQGPPGPKGQQGYPGPPGEQGPPGPKGQQGYPGPPGEQGPPGPNMPRTYRWVVRNASGSVTVPVGSPVEFDLTSGTENITFNGSDALTIMDPGVYVLEYFLVLEATSTSPNIFTIFTNGVQTQRSMSNTTGGLLSLSLVLPINEMTTVQVINNSNEPKVLMNQAGNGGVTRQSARLNVYRIQ

SEQ ID NO: 29476 - protein, 862 aa, Bacillus thuringiensis MC28
MTITCNGLQIQAETKEKNVKNVLQMEPVGIQKSVDELAHPSKVQENASFTKRLKLADLSQRPLAPTDNIKPLAEEKKYSMAELNQLSNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTIWYRNIDNFINEVSRFALLGTVSDKNGWLINNGIYYAGRLGKLHSTPTKGQQVVTDAMRIYPFLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLNSVVPRKSIIGGLSNDPAKRYTASQTLNAKYGTWDFYNYSFALQSYMYNKRPEMFDKVHDLIRANDVSSYDAYRSALSKDNNLNEEYQSYMQMLIDNRDKYTIPQVSDEYLAQHDPKSLSDITSDITNEAKLKDVKVTKNKSQFFNTFTLQGTYTGSVAKGEVEDWKVMNEATNDMLKRLSGKEWTGYKTLTAYFINYRVNHAGQFEYDVVFSGVNTEEGTAVEKEPNNSFETANPLFLNTLLRGNLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 29477 - protein, 380 aa, Bacillus thuringiensis MC28
MHMKEKRYKNMKTKQTIAASTLALAMIAGANSAHAEVTDATPQQSTGDRLAEIKQHRQELDAKLQQHKENVDQTLNELNQVKENVDTKVNELHERKQVADEKINEMKQRKQELDAKLQQDKQIAEDKIAEIKEHKKQVDDKVAEIKEHRENIDTKVNEIKEHKQTVDETVNEIKQHKENIDQKVNELKEVKKQVDEKLAELKKAKQTAEDKLAELKENKPNTGNTLEELKKIKGNLDSLSANLELAKQDVKNKLAELQKARQNLLNKINEIKQAKQTVSDDLTKKKQDLDIKINDFKHTEKKIDDKLAELHTTKQNVDNKINEISQSKQTQADNSTKNNNARELPNAGSEQSNNMALGMLSVLGGVLLVTRNKIKTLFSK

SEQ ID NO: 29478 - protein, 259 aa, Bacillus thuringiensis MC28; identical to SEQ ID NO: 29244

SEQ ID NO: 29479 - protein, 1295 aa, Bacillus thuringiensis MC28
MSRYDDSQNKFSKPCFPSSAGRISNTPSIPISKAQIRTFRAIINDLIKIIPKLFANPSLKNIEDLIDTLNLLSKFICSLDATSSLKAQGLAIIKNLITILRNPNFVASAVFVELQILINYLLYITKLFRIDHCTLQELLKLIAKLQTTLVNSASFGRGPTGPTGPRGNTGATGATGPTGPRGNTGATGATGPTGPRGNTGATGATGPTGPRGNTGATGATGPTGPRGNTGATGATGPTGPRGTRGATGATGPTGPRGNTGATGATGPTGPRGNTGATGATGPTGPTGPRGNTGATGPTGPRGNTGATGATGPTGPRGNTGATGATGPTGPRGNTGATGATGPTGPRGNTGATGPTGPRGTAGAAGATGPTGSRGNTGGTGATGPPGPGGAPVATGATGPTGPRGNTGATGATGPTGPRGNTGATGATGPPGPRGNTGATGATGPTGPRGNTGATGATGPTGPRGNTGATGATGPTGPRGNTGATGATGPSGPRGNSGATGATGPTGSRGATGATGATGPTGPGGNTGATGANGPTGPRGATGATGATGPTGLQGNTGATGATGPTGSRGATGATGATGPTGPTGPGGNTGATGPPGPRGDSGATGATGPTGSRGNTGATGATGPTGPRGATGATGATGPTGPRGNTGATGATGPTGPRGGTGATGPPGPRGNPGATGATGPAGSRGNTGGTGATGPAGPRGDTGATGPTGPRGNTGATGATGPTGSRGATGATGATGPTGPRGNTGATGATGPTGPRGNTGATGPTGPPGNTGATGPPGPRGNPGATGATGPAGPRGNTAATGATGPSGPRGNAGAPGATGPTGPRGNTGATGATGPTGPRGTTGATGATGPTGPGGNTGAAGATGPSGPRGTRGATGATGTTGPRGDTGATGATGPAGPRGNTGAAGATGPTAPRGNTGAAGPAGPRGDTGATGPTGPRGNTGATGPTGPRGNTGATGPTGPRGNTGAAGATGPSGPRGNTGATGATGPTGPRGTTGATGATGPPGPRGNTGATGPTGPTGPRGNTRATGATGPPGPRGNPGATGATGPQGAQGNTGATGATGPQGVQGNTGATGATGPSGPRGNAGAAGATGPSGPRGNSGATGATGPTGPTGSRGNTGAAGATGPTGPRGTSGATGATGPTGPQGNTGATGATGPQGAQGNTGATGATGPTGPRGNTGATGATGPQGAQGNTGATGATGATGPQGVQGNTGATGATGPQGAQGNTGATGATGPAGPRGNTGATGATGPQGVQGNTGATGATGPLDVKVTRGLLVPLDLKALKVTRAYWTYWT

SEQ ID NO: 29480 - protein, 202 aa, Bacillus thuringiensis MC28
MDEFLSFVALNPGSIGPTLPPVQPFQFPTGPTGSTGATGSTGPTGSTGPTGPTGPTGPTGPTGPTGPTGPTGPTGPTGPTGPTGPTGPTGPTGFNLPAGPASITLTSNETTACVSTQGNNTLFFSGQVLVNGSPTPGVVVSFSFSNPSLAFMVPLAVITNASGNFTAVFLAANGPGTVTVTASLLDSPGTMASVTITIVNCP

SEQ ID NO: 29481 - protein, 971 aa, Bacillus thuringiensis MC28
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQLSNQQLVDLLVTIDWEQITELFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGVQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVAAYDAYRSALSKDANLNKEYQDYMQMLVDNRDKYNVPLVSDDYLATHASKPVSDIAVEITAEANVKNVSVKKNKSQFFNTFTLQGTYTGTAAKGEYEDWKTITQKVNDTLKRLSAKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 29482 - protein, 431 aa, Bacillus thuringiensis MC28; identical to SEQ ID NO: 27130

SEQ ID NO: 29483 - protein, 198 aa, Bacillus thuringiensis MC28
MKKPFYKKWWFWVIVVIIVLGAYGNSNKDKEETKTASTEPKQEVKQETKKDEPKKDEAKKEEPKKELSKEGESSKVNIAVGTVETLESVGSEHINEKAQGVFKVVELTLTNNQKDAITLSSNSFKLVDNQDREFSPSSAAQIKLNVANGGNSKFLLEKLNPGLSQTGKIVFDVPKDAQGLVLKARGGMTGKEITLKLE

SEQ ID NO: 29484 - protein, 956 aa, Bacillus thuringiensis MC28
MMLSISTMALSLGAIQTNVSAEEKVPYNVLHSKPVGIEKPVDEIGHASKAEETLSFQERLKVGDFSQRPASITKNSAVKQAKDSYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNENFNAYVDDRMKGQAVYDMMQGIDYDIQSYLNEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLINNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTFKVVLRVKDDKGKESRSETTVTIKDGSLTESEPNNRKEEANRIGLNTTIKGSLIGGDHTDVYTFNVAAAKDLDISVLNEYGIGMTWVLHHESDMQNYAAYGQANGNHIEAKLNAKPGKYYLYVYKYDNGDGTYSLSLK

SEQ ID NO: 29485 - protein, 333 aa, Bacillus thuringiensis MC28
MKSKLLKGVLSFGIGLGALYSGSSAQAETPTNQNNTLKVMTHNVYMLSTNLYPNWGQSERADLIGAADYIKNQDVVILNEVFDNSASDRLLGNLKREYPNQTAVLGRSSGNEWDKTLGNYSSSTPEDGGVAIVSKWPIVEKIQYVFEKGCGPDNLSNKGFVYTKIKKNDSFVHVIGTHLQAEDSMCGKTSPASVRTKQLQEMQDFIKNKNIPNNEYVLIGGDMNVNKINAENNSDSEYASMFKTLHASIPSYTGHTATWDATTNSISKYNFPDSPAEYLDYIIASKDHANPSHIENKVLQPKSPQWTVTSWFKKYTYNDYSDHYPVEATISMK

SEQ ID NO: 29486 - protein, 78 aa, Bacillus thuringiensis MC28
MSAVIKWASSYNIGMELTNENSQFYKVSPINTIDTKTKTSSIGYNIVGEIKVSDKADGGSCFKIKFDQIDTNNLDKRL

SEQ ID NO: 29487 - protein, 746 aa, Bacillus thuringiensis MC28
MGNKSKHKTKRILVATATLTILASGMASSSDVFAEETQQQKKLSTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKLDEATRIQDKVAGLSEEQADKHYIHYVEENHSPDYYMYAYPYRTAYVGDAIQYVLDINKFIKDGWGPWHEAGHLRQQWPWNFYNMTEVQNNIYSLSVEKAFNQPSNLEKSGIYPKAFQYLEQTNKNYDEISDVFVKLVMLWQLQLAYGEDFHPKLHQLYRDMPSSELPQTDETKKQLFMISASKVAKQNLIPFFEKWGLRPNNDTIQKVAALGYPILTAEIWKGTDSNPIKPDMPNGNNILEGNKFAWSLKGISDFEFAKVNFNKSTEEMQIDLKEGIPHHYFNETYASIKVQNASGNVVYKKDIYGNKQQNAELQKVPVKVGDYIELTHLEGVHRATFMNVDNSKQESFGKKAIYEVTKDGLKTVNQIVNPKPDTEAPTQPQGLYAGNVSSNSVELKWNPSTDNVGVKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDTNWIFALSLWKPITIK

SEQ ID NO: 29488 - protein, 746 aa, Bacillus thuringiensis MC28
MKRGQKRKTQNLVMVTATLSMFTIGITPSLEIFAEEQAQQQKVSVLKNEESVKVENRVFTVQGKGDVKALSHLDRRAASFSPFEPTGLYAKPNEEITIDVEGNNEITAYIGAFSYNRNSQGEELVKSFTLKPGTNTIRYEGGGMIYFYNKQEYGTIRTTIQKGGTPVPYFELGKHTKQDLINMLNQNPNSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSRYLVQENKNYDEISDVFVKLAMLWQLHLAYGEEFYPKLHQLYRDMPSNEIPQTDETKKQLFMITASKAAKQNLIPFFEKWGLRPNNDTIQKIASLGYPNLTAEIWESTDSNPIKPDTPNSSNALEGSQFAWSLKGIGDFEFAKVNLNKSTEEMQIDLKAGVPHNYFDSTYASIKVQNTSGKVVYNKEIYGNQQQNAEQAKFPVKVGDFIEFTHLEGAGRAIITNMEKNIQESFGFKVVYEITKEGLKKVDKIVNPKPDTEAPTQPQGLYASNVASNSLELKWNPSTDNVGVKEYQVLHDGQLIQTVQGTTFTDQNLTANKEYKYAVKAVDAAGNTSIQSNILPVKTKDQNVSYEKWDPRKAYTKGDKVEHQGKVYEAVQNHQGNGDPNWIFALSLWKPINLNF

SEQ ID NO: 29489 - protein, 659 aa, Bacillus thuringiensis MC28
MFNQRTRNGVKKILAITAASTVFSMFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWQLIGIMDFPVPNVTFNYGQTLFQEDWLGNGQDVREARVKNGYGRNISDKKWTSWNTQSIEGQEPLNNNWDGGATSEYLWFKAGGNSQSTIGAGKTFTLNQPSEPEIGKLDYDIKSIYYENEKLNVSWKLKENSTPQFKGKIEIYNNENMTGQPINVIDDIKSYQNGISQSISLPTNAYAKIVLTDIFDQTVEKKVQIKNESPNILEGDTFAWSMKGIGDFEFAKVNLNKSSEELQVNLMAGTPHNYFDSTYASIKVQDTSGKVVYNKEVYGNKGQNAESKTVPVKVGDFIELTHLEGGERATLTNLDNNKRESFDKKVIYEITKDGLKKVSQIVNAKPDTEAPTQPQALYASDVASDSVELKWNPSTDNVGVKEYQVLRDGQLIQTVQGTMFTDQNLTANKEYKYTVKAVDTAGNTSVQSNILTVTTKSQNVTYEKWDPKKAYTKGDKVEYQGKFYEAVQSYQGNGDPTWIFALSLWKPFNMK

SEQ ID NO: 29490 - protein, 172 aa, Bacillus thuringiensis MC28
MGKIFKFGCLGIIALFVIGIIAMVAGGGDSTEKTSTDTKAVSKEGVSSDVKISVGSMETVDSVGNEYSKEQAQGIFKILEVTLTNNQKDAITVDTNSFKLVDNKGREFTSSVQGQTSFDLANGGKTDFFLKQLNPGLTQTGKIVFDIPKDAEGLFLKASGGMTGKEIKLKVE

SEQ ID NO: 29491 - protein, 653 aa, Bacillus thuringiensis MC28
MPNKVTAETLMDKFKKSHLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKVGNIGIAPKAKVKVVSQIRGDGSYNTADAIINAVHNLQAGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTKSQNPLTDKIGVLPDLKSILSNLGYSPDISNNVLEGNQFVWSMKGIGDFEFAKLDFNKTKEEMQIQLKAGVPHHYFDSTYASVKVQNSSGKVVYNKDIYGNRQQNAETQKISVKVGDYIEFTHLEGGNRATLINVDKDIQESFDKKIMYQVTVNGLKKVDQIINPNPDTEAPTRPEGLQATNITATSVELKWNSSTDNVGVKEYQVLRDGKFIQTVQGTTFTDSKLTANIEYKYTVKAIDAAGNESIQSSVLSIKTKEQNTSYEKWDPRKAYTKGDRVEYQGKIYEAVQSYQGNGDSNWIFSLSLWKTISIS

SEQ ID NO: 29492 - protein, 762 aa, Bacillus thuringiensis MC28
MQQSKVKNKKGEIILKRISSLLLTMPIILGSIATIPHTKVSAETMSFNQETFTLETLNQQTDQAIANGNFEAHLKNLTAYLNGNVGGTTEENLKKKLADPVFASALAQWQFISQSGATTMSTFAKKDADHQKFLGWAMKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLIDYVTHNKDGVSIHAGNDAFYGLGWNLSSIYRFGGVCGNISKFGTQVSQAFGVAAMPVGQPGHCALIWNNKPYSWNLGNDISGWSESSRHDATVIPWSDNSPTNQAPYMLLFENAERDPVKLDQSERLRWLAKAMTSTDNKIAIYKISTNILPINFLVWKDYVSLMLQNPNVTDAEWKELNNSIISVFANEPRPMMDLLTQIKNHVPNTDDILEGDQFAWSLKGIGDFEFAKVNFNKSTEEMQINLKAGVPHNYFDSTYASIKVQNTSGKVVYNKEVYGNKQQNDETQKVPVKIGDFIELTHLEGRERAILINLDNNKRESFDKKAMYEVTKDGLKKVNQIVNPKPDTEAPTQPQGLYASNLTSNSVEIKWNPSTDNVGIKEYQVLRDGQLIQTVQGTTFTDQNLTANKEYKYAVKAVDAAGNTSIQSNILPIKTKNQNVSYEKWDPKKAYTKGDKVEHQGKVYEAVQNHQGNGDPNWIFALALWNPLT

SEQ ID NO: 29493 - protein, 162 aa, Bacillus thuringiensis MC28
MLKKVSQIVLICGIAFSLSACTETENSNESKQENVQEKIYKIGETVDVDGLQVTLDSVQLGYPDYTIDKKKDDILGIVFTVKNNSKKEIPFAFYEFEITNKKGTKFKEYKYDSFISKKVAPDEKIQDIMRFDVDKENTYIATYRPEFTRENRTIKFELKPNK

SEQ ID NO: 29494 - protein, 508 aa, Bacillus thuringiensis MC28; identical to SEQ ID NO: 29248

SEQ ID NO: 29495 - protein, 333 aa, Bacillus thuringiensis MC28
MKSKLLKGVLSFGIGLGVLYGGSTAQAATSTNQNDTLKVMTHNVYMLSTNLYPNWGQSQRADLIGAANYIKGQDVVILNEVFDNSASDRLLGNLKKEYQYQTAVLGRSNGSEWDKTLGSYSSSNPEDGGVAIVSKWPIVEKIQYVFEKGCGPDNLSNKGFAYTKIKKNDRFVHVIGTHLQAEDDGCGQTTPASVRAAQLKEIQEFIKNKNIPSNEYVLIGGDMNVNKINAVNNINSEYRSMLDTLHASSPAYTGHTATWDATTNSIANYNFPNAPAEYLDYIVSSKDHANPVYIENKVLQPNSPEWSVTSWYQTYTYNDYSDHYPVEATLFMK

SEQ ID NO: 29496 - protein, 669 aa, Bacillus thuringiensis MC28
MIIKKYPFRTLAKTAVALTMIIPTSLAISHPFAYAQKNIAESQQQVAPFWNKNKDYPGESYVTYEGKVYHSLYWANAGTLPTQQFSGWELYTGSEYIPDNSDPNDLFGEGITWPSHVFAPYVDNGMNPQNLLKYAQETNTNFFTLSFIVADKNGNPVWGGSHAPIGDGNLDDQIKQIRKIGGDVKVSFGGANAGNIPGLGADLAAAITDVNKLKDAYKSVINTLHLTHMDFDIEGALVAHPESIERRSKAIALLQKELKAEGKDVKIGYTLPVMPYGLTNDGINVIQSAIKHDVDLNSINIMTMDYGQQNQQMGQAAIDAINSLHEQLTNLYKDTIKDSDIWKMIAVTPMIGKNDTQNETFTLNNAKELFQFAKEKGIGEISMWSVYRDKKATESWQIGEATADASGLPDVDDGAFSKLFSAFNSSTEIDVIAPTAPSNLRSVNQTTTTTTVELQWEASTDNVGVKEYEVYRDGKKVGTTKTTRYEDTGLQPNTKYNFTIKAVDAAGNKSKSSNEVSVTTKEKNPEQVAPTAPTGLQASETTTNSVHLLWEKSTSNVGIKEYEIYRNGTKIGTSPSAHYTDENLLASTEYRYMVKAIDTQGKVSVASNEIKITTKDKPSSEYKAWDSYAAYKKGDRVEHQGKIYETVQNYQGYGDPNWIFSLALWKVIK

SEQ ID NO: 29497 - protein, 67 aa, Bacillus thuringiensis MC28
MWNCFTLNLPTAHADTKIESIVDIGENGQNAKVYNNFSTLFDAQTKIKTSLLVSIIDDPYSIELLAT

SEQ ID NO: 29498 - protein, 72 aa, Bacillus thuringiensis serovar andalousiensis BGSC 4AW1
MDQEPKGNNQVVENEGRKADTLNKQYTNKPEERKKSLPSTGGEASTSTLLSGITLVLSALSMFVFRKRLFKK

SEQ ID NO: 29499 - protein, 965 aa, Bacillus thuringiensis serovar andalousiensis BGSC 4AW1
MNKKSKINKVMLSISTMALSLGALQAPVSAEEKVPYNVLKTKPVGIEKPVDEIGHVSKAEETLSFQERLKVGDFSQRPASITNKATVKQVKESYSMADLNKMNDQELVETLGSIKWHQITDLFQFNEDAKAFYKDKRKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVATTKNIDISVLNEYGIGMTWVLHHESDMQNYAAYGQANGNHIEANFNAKPGKYYLYVYKYDNGDGTYELSVK

SEQ ID NO: 29500 - protein, 333 aa, Bacillus thuringiensis serovar andalousiensis BGSC 4AW1; identical to SEQ ID NO: 26112

SEQ ID NO: 29501 - protein, 362 aa, Bacillus thuringiensis serovar andalousiensis BGSC 4AW1
MPSALFLCYDINEIRHISTKIKGSDRMKRSKTYLKCLALSAVFASSALVLSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHVDDYQLRPGYTFGTANWVGNNVKDVDQKTFNKLFTLDWKNKKLVEKK

SEQ ID NO: 29502 - protein, 503 aa, Bacillus thuringiensis serovar andalousiensis BGSC 4AW1; identical to SEQ ID NO: 26407

SEQ ID NO: 29503 - protein, 412 aa, Bacillus thuringiensis serovar andalousiensis BGSC 4AW1; identical to SEQ ID NO: 26362

SEQ ID NO: 29504 - protein, 455 aa, Bacillus thuringiensis serovar andalousiensis BGSC 4AW1
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVPGTYFIDKKLQPSTEYSYTVKAIDAAGNVSKESATLTVKTTVEVPDTEAPTQPKGLHSMGTTASSVDLMWSPSDDNIGVDHYDIYRETKGLMEKIATSNTTSYMDKYLLSNTTYKYVVKAVDVAGNESVQSDIFIITTKTESVSYEEWDAKKAYEKGDRVLHEGKVYEAVQSYKGNGDPNWIYALSLWKTV

SEQ ID NO: 29505 - protein, 372 aa, Bacillus thuringiensis serovar andalousiensis BGSC 4AW1; identical to SEQ ID NO: 26664

SEQ ID NO: 29506 - protein, 74 aa, Bacillus thuringiensis serovar andalousiensis BGSC 4AW1; identical to SEQ ID NO: 27864

SEQ ID NO: 29507 - protein, 971 aa, Bacillus thuringiensis serovar andalousiensis BGSC 4AW1
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFNTFTLQGTYTGTTAKGEYEDWKSITQNVNDTLKRLSVKEWTGYKTVTAYFVNYRVNASGQFEYDVVFHGINTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 29508 - protein, 779 aa, Bacillus thuringiensis serovar andalousiensis BGSC 4AW1
MLAGATLAIGVMAPQVMPATAHADENTGESTVNLRILETSDIHVNLMNYDYYQTKTDNKVGLVQTATLVNKAREEVKNSVLFDDGDALQGTPLGDYVANKIKDKDPKNPVDPNYVHPLYRVMNLMKYDVISLGNHEFNYGLDYLKEVTSKTKIPVINSNVYIDDHDGNDENDEHYFDRPYHILEKEVVDEAGQKQIVKIGVMGFVPPQIMNWDKANLEGQVKAKDIVETAKKMVPKMKAEGADVIVALAHSGVDKSGYNVGMENASYYLTEVPDVDAVLMGHSHTEVQDIFNGVPVVMPGVFGSNLGIIDMQLKKVNGKWEVQKKNQSKPALRKIADSKGNPLVESDQKLVNEIKDEHEKTIEYVNTPVGETKAPINSYFSLVQDDPSVQIVTNAQKWYVEQELKKPEYEKIKDIPVLSAGAPFKAGGRNGAAYYTDIPAGTLAIKNVADLYVYPNTLYAVKVNGAQVKEWLEMSAGQFNQIDPKPKEKIEQQLVNTGYPTYNFDIIDGLKYEIDVTQPAKYDKDGKVVNANANRIVNMTYEGKPVADNQEFIVATNNYRGSSQTFPGVSKGEVVYQSQDETRQIIVKYMQETPVINPTADQNWTFKPIVADKLITTFDSSPKAKEYIKKDGKISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 29509 - protein, 363 aa, Bacillus thuringiensis serovar andalousiensis BGSC 4AW1
MSSWRNNINGYCSCNNQNGVHVDSCCFSCDGTVPKLGPTGPTGATGATGATGATGATGVTGVTGVTGATGITGVTGITGATGITGATGPTGATGITGATGATGITGATGATGITGATGATGITGATGATGATGATGPTGATGITGATGATGATGVTGSTGATGITGITGVTGVTGATGITGVTGSTGATGITGATGPTGATGITGATGITGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 29510 - protein, 117 aa, Bacillus thuringiensis serovar andalousiensis BGSC 4AW1; identical to SEQ ID NO: 26874

SEQ ID NO: 29511 - protein, 148 aa, Bacillus thuringiensis serovar andalousiensis BGSC 4AW1
MKKKLLPICAIALLTVGYSSVASADTGTVTKEEATQLQQDKAKKEAAIKEQQKIEEEKKRIAQEQLKNDMAKKEEAIKAQQKSEEGKKEAAQVQQKNAATKKEVAKPAVQGEKLPNTASNNVTMMALSACLVGIGTLFGLKRRNKVKA

SEQ ID NO: 29512 - protein, 50 aa, Bacillus thuringiensis serovar andalousiensis BGSC 4AW1; identical to SEQ ID NO: 27362

SEQ ID NO: 29513 - protein, 80 aa, Bacillus thuringiensis serovar andalousiensis BGSC 4AW1
MKNKKEEKASFPSKPNKPTPNGEVKPSADVKPMQQPSTHNEVRLPATGGVSNEFTVLFVLGISFIIAGAYVLRMKNRKEM

SEQ ID NO: 29514 - protein, 431 aa, Bacillus thuringiensis serovar andalousiensis BGSC 4AW1; identical to SEQ ID NO: 26106

SEQ ID NO: 29515 - protein, 185 aa, Bacillus thuringiensis serovar andalousiensis BGSC 4AW1
MTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 29516 - protein, 163 aa, Bacillus thuringiensis serovar berliner ATCC 10792; identical to SEQ ID NO: 29310

SEQ ID NO: 29517 - protein, 949 aa, Bacillus thuringiensis serovar berliner ATCC 10792; identical to SEQ ID NO: 29311

SEQ ID NO: 29518 - protein, 176 aa, Bacillus thuringiensis serovar berliner ATCC 10792; identical to SEQ ID NO: 29312

SEQ ID NO: 29519 - protein, 348 aa, Bacillus thuringiensis serovar berliner ATCC 10792; identical to SEQ ID NO: 28304

SEQ ID NO: 29520 - protein, 172 aa, Bacillus thuringiensis serovar berliner ATCC 10792; identical to SEQ ID NO: 28096

SEQ ID NO: 29521 - protein, 336 aa, Bacillus thuringiensis serovar berliner ATCC 10792; identical to SEQ ID NO: 27901

SEQ ID NO: 29522 - protein, 503 aa, Bacillus thuringiensis serovar berliner ATCC 10792; identical to SEQ ID NO: 26634

SEQ ID NO: 29523 - protein, 893 aa, Bacillus thuringiensis serovar berliner ATCC 10792; identical to SEQ ID NO: 29345

SEQ ID NO: 29524 - protein, 563 aa, Bacillus thuringiensis serovar berliner ATCC 10792; identical to SEQ ID NO: 29318

SEQ ID NO: 29525 - protein, 455 aa, Bacillus thuringiensis serovar berliner ATCC 10792; identical to SEQ ID NO: 29336

SEQ ID NO: 29526 - protein, 878 aa, Bacillus thuringiensis serovar berliner ATCC 10792; identical to SEQ ID NO: 29319

SEQ ID NO: 29527 - protein, 378 aa, Bacillus thuringiensis serovar berliner ATCC 10792; identical to SEQ ID NO: 29320

SEQ ID NO: 29528 - protein, 614 aa, Bacillus thuringiensis serovar berliner ATCC 10792; identical to SEQ ID NO: 29321

SEQ ID NO: 29529 - protein, 223 aa, Bacillus thuringiensis serovar berliner ATCC 10792; identical to SEQ ID NO: 29346

SEQ ID NO: 29530 - protein, 450 aa, Bacillus thuringiensis serovar berliner ATCC 10792
MERLRKSKKGIGACLLAAGVTAITMIPQSAYAHGFVEKPSSRAALCSQNYGALNLNCGNVMYEPQSLEAPKGFPDGGPIDGKIASAGGLFGGTLDQQTTNRWFKNTIKGGENTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDKEAPTQPKGLHSMGTTATTVDLMWSPSEDNVDVDHYIVYRESAGVMNKIGTSANTSFIDKGLKANTSYKYVVTAVDLAGNESSRSDVLNITTKLEDSTYEKWDARKVYTKGDRVVHEGKVYEAVQDHQGNGDSNWIFALSLWKPVLNK

SEQ ID NO: 29531 - protein, 746 aa, Bacillus thuringiensis serovar berliner ATCC 10792; identical to SEQ ID NO: 29325

SEQ ID NO: 29532 - protein, 412 aa, Bacillus thuringiensis serovar berliner ATCC 10792; identical to SEQ ID NO: 29326

SEQ ID NO: 29533 - protein, 1062 aa, Bacillus thuringiensis serovar berliner ATCC 10792; identical to SEQ ID NO: 29327

SEQ ID NO: 29534 - protein, 971 aa, Bacillus thuringiensis serovar berliner ATCC 10792; identical to SEQ ID NO: 29328

SEQ ID NO: 29535 - protein, 368 aa, Bacillus thuringiensis serovar berliner ATCC 10792; identical to SEQ ID NO: 29329

SEQ ID NO: 29536 - protein, 1225 aa, Bacillus thuringiensis serovar berliner ATCC 10792; identical to SEQ ID NO: 29330

SEQ ID NO: 29537 - protein, 65 aa, Bacillus thuringiensis serovar berliner ATCC 10792
MKPEDPKDLKQPEVRLEKLIKEPQVKTERELPKTGAASPWMMSVGAGISFLVGGVLFVLGRRRKQ

SEQ ID NO: 29538 - protein, 431 aa, Bacillus thuringiensis serovar berliner ATCC 10792; identical to SEQ ID NO: 26534

SEQ ID NO: 29539 - protein, 810 aa, Bacillus thuringiensis serovar berliner ATCC 10792
MFAPTRDNTLIYDQQTANSLLDTKQQEYQSIRWIGLIQSKETGDFTFNLSDDQNAIIEIDGKIISHKGQNKQVVHLEKGKLVPIKIEYQSDQILTRDSNIFKEFQLFKVDSQQHSHQVQLDELRNPDFNKKETQQFLEKAAKTNLFTQNMKRDTDDDDDTDTDGDSIPDLWEENGYTIQNKVAVKWDDSFAAKGYTKFVSNPLESHTVGDPYTDYEKAARDLDLANAKETFNPLVAAFPSVNVNLEKVILSPDENLSNSVESHSSTNWSYTNTEGASIEAGGGPLGISFGVSANYQHSETVAKEWGTSTGNTSQFNTASAGYLNANVRYNNVGTGAIYEVKPTTSFVLDKDTVATITAKSNSTALSISPGESYPKKGQNGIAINTMDDFNSHPITLNKQQLDQLLNNKPLMLETNQADGVYKIKDTSGNIVTGGEWNGVIQQIQAKTASIIVDTGESVSEKRVAAKDYDNPEDKTPSLSLKEALKLGYPEEIKEKDGLLYYKDKPIYESSVMTYLDENTAKEVEKQLQDTTGIYKDINHLYDVKLTPTMNFTIKLASLYDGAENNDVKNGPIGHWYYTYNTGGGNTGKHQYRSANPSANVVLSSEAKSKLDKNTNYYLSMYMKAESDTEPTIEVSGENSTITSKKVKLNSEGYQRVDILVPNSERNPINQIYVRGNNTTNVYWDDVSITNISAINPKTLTDEEIKEIYKDFSESKDWPWFNDVTFKNIKPLENYVKQYRVDFWNTNSDRSFNRIKDSYPVNEDGSVKVNMTEYNEGYPLRIESAYHLNISAITYDGREIPVYSSSWPSNK

SEQ ID NO: 29540 - protein, 183 aa, Bacillus thuringiensis serovar berliner ATCC 10792; identical to SEQ ID NO: 26916

SEQ ID NO: 29541 - protein, 61 aa, Bacillus thuringiensis serovar berliner ATCC 10792
MKVGIKMDNEKYLQVVEDEELEQLVGGIGPGWVETLTKDCPWNMPVACVTIMGQRICKKCR

SEQ ID NO: 29542 - protein, 719 aa, Bacillus thuringiensis serovar berliner ATCC 10792
MFAPTRDNTLIYDQQTANSLLDTKQQEYQSIRWIGLIQSKETGDFTFNLSDDQHAIIEIDGKIISHKGQNKQVVHLEKGKLVPIKIEYQSDQLLNRDSNIFKEFKLFKVDSQQHAHQVQLDELRNPAFNKKETQQFLEKASKTNLFTQDIKRDTDDDDKDTDGDSIPDLWEENGYTIQNKIAVKWDDSFAAKGYTKFVSNPLDSHTVGDPYTDYEKAARDLDLANAKETFNPLVAAFPSVNVNLEKVILSKDENLSNSVESHSSTNWSYTNTEGASIEAGAKPEGPTFGVSATYQHSETVAKEWGTSTGNTSQFNTASAGYLNANVRYNNVGTGAIYEVKPTTSFVLDNNTFATITAKSNSTALSISPGESYPKKGQNGIAINTMDDFNSHPIKLNKQQLDQVLNNDPIMLETNQADGVYKIKDTSGNIVTGGEWNGVIQQIQAKTASIIVDTGESVSEKRIAAKNYDNPEDKTPSLSLKEALKLGYPEEIKEKDGLLYYNDKPIYESSVMTYLDENTAKEVKEQLNDTTGKFKDVKQLFDVKLTPKMNFTIKLATLYDGAEDGSSPTDKGISSPLGEWVFKPDINNVEGGNTGKRQYRLSKSQDDNIYYGMLAFTSEVSNKLKKNYQYYISMSIKADIGVEPTVSIIGASDRIVNKQFKLNSNGYQRFDILVDNSESNPIDAILLDLGVSNQAPINYSKDIYIDDITITEVSAMKEKN

SEQ ID NO: 29543 - protein, 451 aa, Bacillus thuringiensis serovar berliner ATCC 10792
MVSKKLQLVTKTLVFSTVLSIPLLNNSEIKAEQLNMNSQIKYPNFQNINIADKPVDFKEDKEKAREWGKEKEKEWKLTATEKGKINDFLDDKDGLKTKYKEINFSKNFEYETELKQLEKINSMLDKANLTNSIVTYKNVEPTTIGFNHSLTDGNQINSEAQQKFKEQFLGNDIKFDSYLDMHLTEQNVSGKERVILKVTVLSGKGSTPTKAGVVLNNKEYKMLIDNGYILHVENITKVVKKGQECLQVEGTLKKSLDFKNDSDGKGDSWGKKNYKEWSDSLTNDQRKDLNDYGARGYTEINKYLREGGTGNTELEEKIKNISDALEKNPIPENITVYRYCGMAEFGYPIQPEAPSVQDFEEKFLDKIKEEKGYMSTSLSSDATSFGARKIILRLQIPKGSSGAYVAGLDGFKPAEKEILIDKGSKYHIDKVTEVVVKGIRKLVVDATLLLK

SEQ ID NO: 29544 - protein, 969 aa, Bacillus thuringiensis serovar berliner ATCC 10792
MEYIIGGNIMNKNLKFTQMMIGISTVALSFGSIQTQVSAEEKVPYNILQMKPIGTETSKDEMVHATKTDEILTFEERLKVGDFSQRPTLAMKRDESQLKQSYTLAELNKMPDRELIDTLSKISWNQITDLFQFNQDTKAFYQNKERMNVIINELGQRGKSFTKEDSKGIETFVEVLRSAFYVGYYNNELSYLKERSFHDKCLPALKAIAKNLNFALGTAEQDRVVAAYGKLIGNASSDTETVQYAVNILKQYNDNLSTYVSDYAKGQAVYEIVKGIDYDIQSYLQDTNKKPNETMWYGKMDNFINEVNRIALVGNITNENSWLINNGIYYAGRLGKFHSNPNKGLEVITQAMSLYPHLSGSYFVAVEQIKTNYGGKDYSGNTVDLQKIREEGKQQYLPKTYTFDDGSIVFKTGDKVTEEKIKRLYWAAKEVKAQYHRVIGNDKALEPGNADDVLTIVIYNDPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVAPRKSMISGLSSDPASRYTAKQTLFSKYGSWDFYKYSFALQLYLYNHQFETFDKLQDLIRANDVKNYDLYRESLSNNTQLNAEYQAYMQQLIDNQDKYNVPQVTNDYLIQHAPKPLAEVKNEIVDVANIKDAQITKYESQFFNTFIVEGKYTGGTSKGESEDWKAMSKQVNQTLEQLSQKGWSGYKTVTAYFVNYRVNAANQFEYDIVFHGVATEEKEKKTTIVNMNGPYSGIVNEEIQFHSDGTTSENGKVISYLWNFGDGSTSTKANPTHVYGEKGTYTVELTVKDSRGKESKEQTKVTVKQDPQTGGSLEEEKVLPFNTLVKGNLVTPDQTDVYTFNVTDPKEVDISVVNEQNIGMTWVLYHESDMQNYVACGEDEGNTIKGKFVAKPGKYYLNVYKFDDKNGEYSLLVK

SEQ ID NO: 29545 - protein, 893 aa, Bacillus thuringiensis serovar chinensis CT-43; identical to SEQ ID NO: 29345

SEQ ID NO: 29546 - protein, 553 aa, Bacillus thuringiensis serovar chinensis CT-43
MKKIFSVLLVFFLTFSTWSSVLVKADSPSKGTLTIHKYEQEKDGAQGLEGDGSANQEVPKDAKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLEYGEYYFQETKAPKGYVIDPTKREFFVKNSGTINEDGTITSGTVVKLEVKNYEEPTIDKKINGKSEALPINPLTNYNYDIKTLIPEDIKEYKKYVVTDTLDNRLVIQGKPIVKIDGAEVNTSIVEIAIEGQKVTATVKDFTKLDGKKEFHLQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 29547 - protein, 635 aa, Bacillus thuringiensis serovar chinensis CT-43
MLSVSFVVYVPKEAYGSTTNLEGLGDISRYNAVVFGNHKAIGGDIEGAIAVQGDMDASGYTIVGAAAGTSNIVGEKWVDEGYPSLLLSGKFKKSREESFIIQNGIVVMTKESDPDRIIQSSYDRIVYKEKLEIDAKFNEFRNIVNQVSKNAGQYKTNTPIPNMSHGIGKDINNPNIYVSSELTGEINLDIRDVFLPNAKDKDFIVMYSDVTEVTFKNGSILYDTNNIGRATDIVPTSQPYSPNSPFTELYGKVIWVFPNAKKITTEGYGVVGSVFAPNAVLETKGGSINGQAFVGAVQQTGGFEFHNFKFNWQHWNKPSTGKVKIKKVDSNNDNKKLVGAKFHIEDSKGKVVGELITDEKGEMISKDLPIGNYTLVEVEAPKGYELLKEKITVKIEKDAVVEIKIGNKKLPDPMGKMKLVKVDISDKNKKLAGAKFHIEDPKGKIVGELVTNEEGEAISKDLPIGNYTLVEVEAPKGYELLKEKITVKIEKDAVVEIKIGNKKLPNPTGQFEIEKVDDKDSELKLKGAVFQVLDKEGKEVSRLITDEKGKVISNQLAIGKYTIKEMKAPNGYTLLRDPIEIEITEAVKTQKITVKNTKNNWVIPNTGGSGTTIFYVIGIMLMFGVLYFCKKNRIL

SEQ ID NO: 29548 - protein, 249 aa, Bacillus thuringiensis serovar chinensis CT-43
MSKFKKNCCHIPFPLPQIGPSGPSGPTGITGATGPTGITGATGPSGGPPGPTGPTGITGATGPSGGPPGPTGPTGITGATGPSGGPPGPTGPTGLSGIVGATGPTGPTGLTVSGLSHYAYVFNTAAQVVALEAPILFNSHGRMTSGFTHTLGTSQLMVLNAGDYKISFSVSGVEPNQFTLFLNGAPVTSAVYGSGAGTQQNNGQTILALAAGDIITLNNHTSAAAVTLQTLAGGTQTNINASIVIEKLN

SEQ ID NO: 29549 - protein, 142 aa, Bacillus thuringiensis serovar chinensis CT-43
MILGTIADTPNTPPLFFLFTITSVNDFLVTVTDGTTTFVVNISDVTGVGFLPPGPPITLLPPVDVGCECECRERPIRQLLDVFIGSTVSLLASNGSIAADFNVEQTGLGIVLGTLPINPTTTVRFAISTCKITAVNITPATI

SEQ ID NO: 29550 - protein, 306 aa, Bacillus thuringiensis serovar chinensis CT-43
MNIKQSFKLLAMFLSVLFVLFPLQKAFAEVMDHTKYEMNWSYSKSKKKPIRTELIKTADGKIAFCLNVDLKSPSGQDLPEMGKVDINVYRVLLNGYPQKSPQELGVSDWREAHYATQLAVWNALKQIDVNDLDFRNKNVEKVTKDIVAKANASEELQEITMSVTPTEEQEAVLKNDFFETGLYTVETNAKSGTYKVQATGAPAGVKFANEKGETKTEFNVGEKFRILIPKQTPAGGFSFKVSGNLTKLQGIAHKGTPTIQNAVVLLERSEEKTSPELAVSWKKPEGPQTPNKPYTPNEPHKPNQKR

SEQ ID NO: 29551 - protein, 431 aa, Bacillus thuringiensis serovar chinensis CT-43; identical to SEQ ID NO: 26534

SEQ ID NO: 29552 - protein, 455 aa, Bacillus thuringiensis serovar chinensis CT-43; identical to SEQ ID NO: 29336

SEQ ID NO: 29553 - protein, 163 aa, Bacillus thuringiensis serovar chinensis CT-43; identical to SEQ ID NO: 29310

SEQ ID NO: 29554 - protein, 3330 aa, Bacillus thuringiensis serovar chinensis CT-43
MKKLFNVCLIVFVLFSQLASFPYNQVKAEILTGDSLFDTVEMKDATNHIIDEAKNPNNLIKIGSTIQVEYAWSIKDQQAAHANDTAVVQIPLALKVSKDLQGDLVTDQKNIGQYFITAKDNKLKLIFNNQVENLKDAKGKIKVDTVFNSTLKTGEKSVQIAFPLGTMVQPISVPVQVENSKEDGTKQDTNKQAQDPVAKPVTDNPEQDPATKTVTDNPEQNPATKTVTDNPKQNPTTKTVTDNPEQNPAAKTATDNPEQNPAAKTATDNPEQNPAAKTATDNPEQNPAAKIATDNPEQKLASAPAENTNSGPKQITTNILTSVKLTDKDGKPFTEDNRPSTDSPANIEFTWELLKSMNVKNGDYYIFDLPKHFKIYNTINSPLYDSENHQIGNFTVTKDGKVTMTFNDYVEEHPDVAGNLQLKTEFNKAEIKGTTTQEIPFPIKDKDVSITVDFKPNVQTATNKKGLPDRPINTNEINWKVEMNKTKDTLKNAVFKDNIPQGTSLNKDSIKVYYLEVDVNGNVTRGAEAEPTDYNIISSDGSKLEIAFKDSINKAYQIEYATKITDENIKSFRNNVTITSDNQKQQNASSTVTVSRGTHLNKTSKYDPKTQTIEWTITYNGDQREIKKADAILKDIFDDTHELDANSIVVKNASYNEKGTLVTGDAVNNYTVSNKKNGFDLQFNDDINSAYVITYKTKPTNKVIEDGKVKNKVTADNDSSKENEASFKQQNIIKSNNKAETNYKDKTTTWTIIVNNNNYPLSNAIITDTFDHGGLQLKDKKLEIKDGNYTLQAGTDYVLDVTDKGFKITLIGTYQSNMTKTLVVKYTTDFDYTKLESGKNSFKNTGNLSWIDTDSNPQSNKVEANFDPDTFTKANGYKYGSYNAQTKEITWIIGFNYNNVEIKDPYVIDVIQDKQKLVPGSIEVRDMILNGNPDNAQPGNAVPTEKYELEEPTEKNKNTLKVHFKQSINSPYYIIFKTSLDGELIQGTYKNEADLKDGSKIVNTLTGDTQVNKGGSFVTKKAVQDDNYINWSIAINESQSTIADAVVTDDPTENQVIVEDSFHLYPTTIDPYGNLTKDTVNELKEGTDYKLKITTDNNTGKQHFEIAFLKKIDRAYILEYRSLINADDKEKVSNKAKITGNKLTVKNTETTETIEVRMSSGSGGGSATKGRGNLEIIKVDNDNKNALLAGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNDQGQITVDNLKPGTYYLQETTAPEHYKLDSTPIQFTIKEDQTTVINRTATNSLIPGSAILTKFDKDGKTLAGAEFSVRDRYNKVIRGYEKLTTNDQGQIEAKDLRPGDYQFVEEKAPKDYDIDKKPIEFTIIKSQKKALTVTATNHLIKGGVTLTKVDDVDGTALEGAVFKIVDANDEKQVIRENIKTGSDGKVTVKDLEPGAYKFIETEAPKDYTLSTNPIEFTIDKSQQTLATVTANNSLKTGEVELLKVDEFGEKKPLEGAVFKLVDTNNNDVSPHTNLTTDKHGKVKVSNLRPGTYKFIEIAAPEHYVLREEPIEFTIDRSQKETLLVKAENALKPGDVELTKVDDIDGTALEGAVFKIVDANDEKKVIRENVKTGADGKAIATGLRPGDYKFIEVTAPKYYDKNTKPIKFTITESQTTQATVTAKNSLTKGGIELTKVNAADEKETLEGAVFKIVNRDTNEDVRTDLVTNSKGMLVVDDLRPGNYKLIETKAPTYYDVNVEPIEFTIEKGQQKLLPLTFKNSLTKGKVKLIKEDDVESSKALAGAVFTLQDATGKEIMKDLTTDDYGVLVIPDLAPGDYQFIETKAPEHYKLDKTPIKFTIKKGSKEDLPIPVTVKNSLLTGGVTLTKVDDVDGTTLEGAEFIIVDAHDTKKVIRKGLTTDKNGKISASDLRPGDYQFIEVKAPKDYTLSKDPIPFTIEKSQKENITVTATNSLKKGAVTLTKIDDIDRTMLEGAIFKIVDMNGKEVHTNLVTDKNGKISVSDLRPGDYQFIETKAPEHYVLDETTIPFTIERSQTKEINVTGKNALKKGSVELTKIDDIDITTKLANAVFNLLDADGELVKEGLKTNDEGKIVVENLRPGTYQFVETIAPEHYDLDKKPIVFTIKKSQTETLHITATNALTKGAVKLSKVDDVDGTVLKDAVFKIVNMNGDVVHKDLVTNEQGIIEINDLRPGDYQFIETKAPKHYVLDETPIKFTIEKGQKKAISLTATNSLKQGSIELLKVDDLNTQTKLADAVFNLLDQDGKVLKTDLKTNSEGKIVIENLRPGTYQFVEITAPEHYDLDKKPIIFTIKKSQKDIATVTMKNSLTKGGVELSKVNDVDGTTLEGAVFKIVNMNGTVIRKNLVTNQQGKISVSDLRPGDYQFIETTAPKHYDLSKEPIPFTITKSQADPISVTATNSLTKGAVELSKVDDVDGTALKDAVFKITDLNGNEIRTELTTDVHGKISVSDLRPGDYQFVETKAPEHYKLDSTPIKFTIKKSQKEKLQVTATNSLTEGAVELIKVDDINPDTKLSDAVFNIIDAKGKIVRTDLTTDKDGKITATNLRPGDYQFIETKAPKHYDLNKTPISFTIERSQLTHASVTAKNGLTKGGVELTKVDSIDKKEMLEGAVFKITDLNGNDIRTNLVTNKDGKIIAKDLQPGDYQFIETKAPKHYDLNEEPIKFTIERSQTKHVFVTAINSLTKGSVELIKVDDAKQNTTLEGAVFKIVNKDGHDVRTDLTTDKNGRLVVDELPPGDYEFIETKAPEHYDLNETPIKFTVKKGQEKIASVTATNSLTKGAVELTKVDNIDGTTLEGAIFKIVDMDGKDIRSDLTTDKDGKISVSDLRPGDYQFIETKAPKHYDLNQNPIKFTVEKSQTAKASVTATNSLTKGAVELTKVDDIDGTTLAGAIFKIVDMNGKDVHSENLTTDKDGKISVSDLRPGDYQFIETKAPKHYDLYQNPIKFTVEKSQTAKASVTATNSLTKGAVELTKVDDIDGTTLAGAIFKIVDMNGKDVHSDLTTDKDGKISVSDLRPGDYQFIETKAPTGYDLNIKPIPFTITKGQSQVTSVTALNSLTTGAIELTKVDIDHHGTLEGAIFNILDQDGKIIREGLKTDQHGKVIVNDLKPGNYQLVETQAPKGYQLDASPINFTIDKAQATPLQITVSNKKIESSSGGDDKPVTPPNKEENKGNETSEKHKNGTSEETSNETDNKQQGDRNTDKHLPNTGHKEDPTQTVGIVLLLAGLLSILATKRKKHY

SEQ ID NO: 29555 - protein, 965 aa, Bacillus thuringiensis serovar chinensis CT-43; identical to SEQ ID NO: 29335

SEQ ID NO: 29556 - protein, 878 aa, Bacillus thuringiensis serovar chinensis CT-43; identical to SEQ ID NO: 29319

SEQ ID NO: 29557 - protein, 176 aa, Bacillus thuringiensis serovar chinensis CT-43; identical to SEQ ID NO: 29312

SEQ ID NO: 29558 - protein, 348 aa, Bacillus thuringiensis serovar chinensis CT-43; identical to SEQ ID NO: 28304

SEQ ID NO: 29559 - protein, 368 aa, Bacillus thuringiensis serovar chinensis CT-43; identical to SEQ ID NO: 29338

SEQ ID NO: 29560 - protein, 475 aa, Bacillus thuringiensis serovar chinensis CT-43
MQGERGITGVSGVTGPQGPQGVQGIQGEQGAIGIQGEDGLQGIQGITGEEGPQGAQGIQGEVGPTGSTGIQGAQGISGIKGITGAIGLQGPQGVQGIQGITGATGFQGIKGIRGITGATGSIGIQGLEGPPGGPTGTTGPIGPSSGVTGPSGPPGPPGGPTGPTGATGSTGVSGEIGPIGAQGVQGITGPTGHQGVRGAQGSQGVVGAVGVQGAQGPQGNQGITGPTGAEGSQGIQGPLGVTGPTGAEGPKGIQGIQGVIGPTGAQGMVGIQGVSGPVGVTGATGATGQTGATGATGPTGIQGIQGITGATGETGPTGATGPTGLTGATGSSAISTGGGYFFSTSTSTIAANANIPINSGSTVYGTGVSLTSATTVTVATPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 29561 - protein, 141 aa, Bacillus thuringiensis serovar chinensis CT-43
MRHHRNCKKFGVALPLPLIGATGPTGNSGPIGPTGGHEGPVGPTGVTGPTGATGPQGPQGIRGIQGPRGTTGAQGIQGAIGDTGEQGITGPTGLQGAQGLIGNQGLIGDIGVQGLEGIQGATGPAGSQGIQGTQGNTRGNR

SEQ ID NO: 29562 - protein, 1105 aa, Bacillus thuringiensis serovar chinensis CT-43
MRKSFNQKIKKLSSSLIVVLLICMNFLIHLPFKAEAATTELKGLGDVSYYNAIIFGDHSATSADIEGAMAVQKNMNASSYTVVAAATGANNLAGATWVDEGYPSLLLGGQFTKAGAGQVIIQDGTVAMTKDGDPDGAMKTSYDRISYKEQAEIDAKFKEFRKDVDGVIGDASKLHTDKPKPNMSFGIGEDVNNPNIYVSSGQTGKKAFDVKDVFLPNVENKDFIVIYSDAEEVSFGGGAILYDTRNTGMATDLINTSQAYDPNSSFTELASKVIWVFPNATKITTKGYGVVGSVFAPNAVVETKGGSINGQAYVGGLHQRDGFEVHNFKFNWPKWNKPAAEKGHLQIKKVDENDKNIVLKDAKFDVIDKDNNVVATVTTNEKGIAEVKDLPLGDYFVKEINAPEGYIKVDTPVKVTIDNTNVIELVMKNTKKVENGQFKLLKKDSESGQLLPGAKFDVIDKDGKVVETIVTDDKGEALSKQLLVGSYTLKEVEAPKGYELSSSSVSVDVEANKVVTVDVVNKKIPEKVTGQFEIVKVDAEDKTKLLSGAEFEVYKDGKKVAELKTDESGKVMSPKLPLGEYTVKETKAPAGYKLSNKEWKVTIQNEKEVVKVEAENEKILGSLQIIKMDDKDQTKRLAGAEFTLKDAKGNVVKEGITTDKSGTVKVDGLVPGEYTLEETKAPEGYELTKQIIHVTVDGEKFVGVKVTNSKSLGQFEIVKVDAEDKTKVLSDAEFEVYKDGKKVDTLRTDKTGKVISQKLEPGTYTLKETKAPQGYKLLKEEIEVVVEADKVVEVQIENAKELGSLQVIKKDAESGKVLAGAEFKLKNEAGQVVGEAKTTNKDGVVKFESLVPGKYTLEETKAPEGYKALEVTVDVNVVANEVVKQEVMNEKMKEEITGQLEITKVDANNTNKILAGAVFEIWKDGTKIDTLTTNKSGKATSKKLEPGDYTLKEIQAPEGYTLSDKEMKFTISNEKIEVVKLQITNKKDTEKGPEKPGEGTEKPGEGTEKPGEGTEKPGEGTEKPGEGTEKPGEGTEKPGEGTEKPGEGVEKPGEGVEKPNFPEKGQGSSNNQQLPATGHNTNYIPFIGFMLLLLGIRLRFMAKNS

SEQ ID NO: 29563 - protein, 503 aa, Bacillus thuringiensis serovar chinensis CT-43; identical to SEQ ID NO: 26634

SEQ ID NO: 29564 - protein, 223 aa, Bacillus thuringiensis serovar chinensis CT-43; identical to SEQ ID NO: 29346

SEQ ID NO: 29565 - protein, 183 aa, Bacillus thuringiensis serovar chinensis CT-43; identical to SEQ ID NO: 26916

SEQ ID NO: 29566 - protein, 458 aa, Bacillus thuringiensis serovar chinensis CT-43; identical to SEQ ID NO: 29324

SEQ ID NO: 29567 - protein, 746 aa, Bacillus thuringiensis serovar chinensis CT-43; identical to SEQ ID NO: 29325

SEQ ID NO: 29568 - protein, 412 aa, Bacillus thuringiensis serovar chinensis CT-43; identical to SEQ ID NO: 29326

SEQ ID NO: 29569 - protein, 1062 aa, Bacillus thuringiensis serovar chinensis CT-43; identical to SEQ ID NO: 29327

SEQ ID NO: 29570 - protein, 971 aa, Bacillus thuringiensis serovar chinensis CT-43; identical to SEQ ID NO: 29328

SEQ ID NO: 29571 - protein, 2089 aa, Bacillus thuringiensis serovar chinensis CT-43
MQMKSTKRHISMVSLVFLVLFSVLNVWAPVIQAAVMKSPVDEINISRTDGTTSEPYQASDGMKVEVKWSAKEKIKSGDQFTIDMPKEFRKDLMNMSFPLKDAEGKTVGTCEMKKGLLTCTMGNYVEGKNNIKGSLFVEFYFGLEAYDGVKEIPLEFNVDGQIVNKEVNVSNTTERPKPQPNTDNLLKWGSYNQEDPSIADWLVYVNATGTEMQDLKLTDTLGPGHELITDSVVLEEAVFEDGYAPTNIKPADLSNIKINATKTGFTIEFPDSSKGYILRYKTKVTNPAAKPHKNTVKLEGKNIKTEEKVGQVFVSGGGGSGSGDNNPPSIEKNIVDENGKLVENEQLTQMDQVIQYQVGTHIPNDPPKYTSMVISDDLEDVLEVLEAKVYDQNGQDITSKGTLNIDKQRSEVTFTFGESFDYKSYEDQIINLSIKAKIKNNADLSSYVDKKIPNKAELHFDDKTLTSKEVTITPPEAPKDGTVSLHKIDSENPNKGLKAAEFEVRNSANEVVAKLKTDEKGFSVPQTLAPGTYKVYETVAPEGYQKLTSPVEVTLQAGETKTIEIKNTMQKGQIEVKKIDSENGEKPLANAEFDIVKDGVVVEHIVTDKDGKAISKPLAPGKYILKETKAPEGYQLKETEFEVNVTGDGIFPIQVENAMVDKGNIEITKVDKENGAVLAGVEFEVQDEKDGVVRKVVTDKEGKANVSDLSVGKYKLVETKSLPGYKNLAEPVLFEITKGMTKALVIKVENEQLDKGSVEITKIDKDSQKVLEGVVFEVQDEQGKVVTEVKTDKDGKAKISDLSVGKYKLVETKSLPGYKKLTEPVSFEITKGMTTVLSLKVENEQLDKGSVEITKVDKDSKKALKGVVFEVQDEAGTVVKEVKTDKDGKAKISDLLVGKYKLVEKESLPGYKKLTDPVLFEIKKGMTKVLSLKIENEMVDTGNVEITKIDKDNKAPLAGVTFIVQDEKGNEVTKVTTDKDGKANVSDLPVGKYELVEVESLPGYKKLEKPVSFEIKKGMTEVLSLKVENEMVDTGNVEITKIDKDSKAPLENVVFEVRDLKGKVVAKVTTDKEGKANVSDLPIGKYELVEVETPAGYKPLEKPISFEIEKGRVTALKLTVENELVDTGNVEITKVDKENKDALADAVFEIQDEAGQVVAKITTDKKGQAQVTNLSVSTYKLVEVKAPKGYKQLVDPITFQIEKGMTKSLALTVENEMLDKGNVEVTKVDKDSQKVLEGVVFEVQDDKGKVVTEVTTDKEGKANVSDLSVGKYKLVETKSLPGYKKLTEPVSFEIKKGMTKVLSLKVENEQLDKGSVEITKVDKESGAVLAGVTFEVQDEKGKVVTKVTTDKEGKVKISDLSVGSYKLVEVENLPGYKKLTEPVSFEIKKGMTEVLSLKVENEQLDKGSVEITKVDKDSQKVLEGVVFEVQDEQGKVVTEVKTDKNGKAKISDLSVGKYKLVEKESLPGYKKLTEPVSFEIKKGMTEVLSLKIENEMVDTGNVEITKIDKDNKAPLAGVVFEVQDDKGKVVTKVTTDKAGKATVSDLSVGKYKLVEVDSLPGYKKLEKPVPFEIKKGMTKSLTFTVENEMVDTGNVEITKIDKDSKARLENVVFEVRDSKGKVVAKVTTDKEGKANVSDLSIGKYELVEVETPAGYKPLEKPVSFEIEKGRVTALQLTVENELVDTGNIEITKVDKENKDALADAVFEIQDAAGQVVAKITTDKKGQAQVTNLSVGTYKLVEVKAPKGYKQLVDPITFQIEKGMTKSLALTVENEMLDKGNVEVTKVDKDSQKVLEGVVFEVQDEQGKVVTEVTTDKEGKANVSDLSVGKYKLVETKSLPGYKKLTEPVSFEIKKGMTKVLSLKVENEQLDKGSVEITKMAAESKEVLSGAVFEVHDEKGKVVVKVTTDKGGKAKIADLSVGNYTLVEVEAPKGYEKLTNPIPFEITNGMINAVQLEVLNKLNHLAPPGPETPDPEKTWNTRSRKAWNTRSRKTWNTESRKTWNTRSRKTWNTESRKTWNTRSRKAWNTESRKTWNTRSRKTWNTESRETWNTESRKIGKRITEDRAENACGTIYGSTSCNDEFWIIRIR

SEQ ID NO: 29572 - protein, 336 aa, Bacillus thuringiensis serovar chinensis CT-43; identical to SEQ ID NO: 27901

SEQ ID NO: 29573 - protein, 176 aa, Bacillus thuringiensis serovar chinensis CT-43
MFINFSLLDINRIILPHSPTGPTGATGSTGPTGAASVGLTNYLYVFDTTNQSIAVGSNVTFNTNGPITGTALSHITGTGNIIINTLGTYLAEFQLQASRENQFSLELNGTPISGGRFGAGSPHTINQGTAAFTVTVVPSTLTLINNTSSAGTITLSNSDGGSLTNVSASISIFQVG

SEQ ID NO: 29574 - protein, 327 aa, Bacillus thuringiensis serovar chinensis CT-43; identical to SEQ ID NO: 29344

SEQ ID NO: 29575 - protein, 42 aa, Bacillus thuringiensis serovar chinensis CT-43
MLQILKKDNKEVVKLETDESDTVIFEALCFEKYKVEEIQVLN

SEQ ID NO: 29576 - protein, 236 aa, Bacillus thuringiensis serovar chinensis CT-43
MFDKNEIKKINEALQANALDPNIIGPTLPPVPPFTLPTGPTGPTGPTGPTGPTGPTGLTGPTGATEGCLCDCCVFPMQEVLQQLVGQTVILATIADAPNVAPRFFLFNITSVNDFLVTVTDPVSTTTFVVNISDVIGVGFSLTVPPLTLLPPADLGCECDCRERPIRELLDTLIGSTVNLLVSNGSIATGFNVEQTALGIVIGTLPIPINPPPPTLFRFAISTCKITAVDITPTGT

SEQ ID NO: 29577 - protein, 178 aa, Bacillus thuringiensis serovar chinensis CT-43
MKKQSLATAITLSLGLSVFGGVTSTFAMTEKSNSITNQPIQMEKGKIHQFNMINATQPIDFGYDTKKNKDAAKEWGAKHYKKWIDDLLKDDTDDKESKESKLERKNEREAIKRYTGNDYTKINTHLRNDRKPANKEFDKEIQYIDRALAKVTTPEAVNVYRRVSEDAFLEKGKKGEKI

SEQ ID NO: 29578 - protein, 103 aa, Bacillus thuringiensis serovar chinensis CT-43
MHFLKKVKKVKKFKEAFNHTEQSEKAYMSTSLVNQTTGNFPKLPILIHLTIPKGKHAAYLGNLAKLPESELLIAHGSSYKINSIEQQVDSKEREYLLIEATLN

SEQ ID NO: 29579 - protein, 163 aa, Bacillus thuringiensis serovar huazhongensis BGSC 4BD1; identical to SEQ ID NO: 28100

SEQ ID NO: 29580 - protein, 333 aa, Bacillus thuringiensis serovar huazhongensis BGSC 4BD1
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTDQLKEIQDFIKNKNIPKNEYVLIGGDMNVNKINTENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATLSMK

SEQ ID NO: 29581 - protein, 416 aa, Bacillus thuringiensis serovar huazhongensis BGSC 4BD1
MFEIKKGMTEVLSLKIENEMVDTGNVEITKIDKDNKAPLAGVVFEVQDDKGKVVTKVTTDKAGKAIVADLSVGKYKLVEVESLPGYKKLEKPVLFEITKGMTKSLAFTVENEMVDTGNVEITKIDKDSKAPLENVVFEVRDSKGKVVAKVTTDKEGKADVSDLSIGKYELVEVETPAGYKPLEKPVSFEIKKGMTKVLSLKVENEQLDKGSVEITKMAAESKEVLSGAVFEVHDEKGKVVVKVTTDKDGKAKIADLSVGNYTLVEVEAPKGYEKLTNPIPFEITNGMINAVQLEVLNKLNHLAPPGPETPDSENPGTPDPENPGIPDPENPGTPNPENPGTPNPENPGTPNSEKPGTPNSENPGTPDPEKPGTQNPEKPEKELPKTGQKMPVEPYMGALLVMMSFGLLVLGRKQQR

SEQ ID NO: 29582 - protein, 179 aa, Bacillus thuringiensis serovar huazhongensis BGSC 4BD1
MFKKIATVTLAGTLAFSLSACDEKKEVAKTVSNNTKEEQSSAKKENTKNEDTREYNIEKTTQIRNQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLELIYRPDVMSKEEVKVELK

SEQ ID NO: 29583 - protein, 503 aa, Bacillus thuringiensis serovar huazhongensis BGSC 4BD1
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKVEGTGKVFLPNPVVSSGSLVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSTEGGAMGEGFGDFLGATYEDAVSTTGYGKACVGEWDAAAYSSSDPTCLRRLDTNKVYPKDIKNQVHADGEIWSQGQYEMAQTFGRDVATKIILQSHWSLTPNSKFSDGAKAIKQADALLYGGQHAADIDRIWAARGISTN

SEQ ID NO: 29584 - protein, 563 aa, Bacillus thuringiensis serovar huazhongensis BGSC 4BD1
MIEVVKGIREMKKIFSVLLVLFLTFSTWSSVLVKADSPSKGTLTIHKYEQEKDGAQGLEGNGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLVKTGVNEKVLAGAVFSLFKKDGTEVKKELVTDANGHIRVQGLEYGEYYFQETKAPKGYVIDPTKREFFVKNSGTINEDGTITSGTVVKLEVKNYEEATIDKKINAKLEALPINPLTNYNYDIKTLIPEDIKEYKKYVVTDTLDNRLVIQGKPIVKIDGAEVNANFVELAIEGQKVTATVKDFTKLDGKKEFHLQIKSQVKEGVPSGSEILNTAKIDFTNKNDVMGEKESKPVVVVPTTGIIELTKIDGANKNKLKGAEFVLKDHNGKIVVVAGKEVTGVSDEHGVIKWSNIPYGDYQIFETKAPTYTKEDGTKASYQLLKDPIDVKISENNQTVKLTIENNKSGWILPVTGGIGTTLFTVIGLTLMLTAALVFFRKKFARN

SEQ ID NO: 29585 - protein, 455 aa, Bacillus thuringiensis serovar huazhongensis BGSC 4BD1; identical to SEQ ID NO: 26530

SEQ ID NO: 29586 - protein, 382 aa, Bacillus thuringiensis serovar huazhongensis BGSC 4BD1
MHMKEKRYKNMKTKQTIAASTLALAMIAGANSAHAEVTDATPQQSTGDRLAEIKQHKQELDAKLQQHKENVDQKLNELNQVKENVDTKVNELHERKQVADEKINEIKQRKEELDAKLQQDKQIAEDKIAEIKEHKKQVEDKVAEVKEHKQNIDNKVNEIKEHKQTVDEKVNEIKQHKENIDQKINELKEVKKQVDEKLAELKKAKQTAEDKLAELKENKPHTGNTLEELKKIKGNLDSLSANLELAKQDVKNKLAELQKAREDLLNKINEIKQAKQTVSDDLTKKKQDLDIKINDFKHTEKKIEDKLGEVHTTKQNVDNKINEVSQSKQTETKTGTTNTNNNAKELPNAGSEQSNNMALGMLSVLGGILLVTRNKIKTLFSK

SEQ ID NO: 29587 - protein, 813 aa, Bacillus thuringiensis serovar huazhongensis BGSC 4BD1
MLVKNQDKCSKFQAPIPFPPPGITGPTGPTGPTGSLGGPTGPQGIQGVQGPIGPTGPQGIQGVQGVQGENGPTGPTGLTGPQGSQGNQGPMGERGPQGIQGERGPTGPTGIQGIQGIPGPIGPTGPTGIQGIQGVQGPIGPIGPTGIQGIQGVQGENGPTGPTGNTGIQGVQGNLGGSGLQGVTGIQGLQGPIGPTGPTGSQGIQGEQGPMGPQGETGVQGLQGPQGEMGQVGPTGIQGIQGVQGVIGPTGPTGLQGDPGPTGPTGATGITGPTGSATGPTGATGPTGPPGGPTGPTGPAGSPGGPTGPTGATGATGATGATGATGIQGVQGIQGPTGATGLTGLQGVQGPMGATGPTGDQGIQGPQGIQGVTGPTGPQGLQGIQGSIGPTGPQGVQGIQGEQGVRGATGPTGLQGLQGIQGPSGPTGPQGVQGVQGPSGITGPTGPQGIQGIQGPQGSIGPTGPQGIQGVQGPQGPTGEAGATGPQGIQGIQGPIGPTGPQGIQGIQGVQGPQGPTGPTGPQGLQGITGQAGATGPTGATGPTGETGPQGPQGIQGPQGETGPTGATGQTGVTGPQGIQGIQGPQGITGQAGATGLTGETGPQGPQGIQGPQGITGPTGATGQTGVTGATGPTGIQGIQGMTGATGVTGGTGPTGATGPTGLTGATGSSAISTGGGYFFSTSTSTIAANANIPINSGSTVYGTGVSLTSATTVTVATPGIYLVSYYFQGDATGGNETVSVRLLLNGTQLTGSFIQNVTTSTVVIEPAISNTLLVNVTSANSTLILQNGPLGVGHVTTIAGAITASLNVVRIL

SEQ ID NO: 29588 - protein, 824 aa, Bacillus thuringiensis serovar huazhongensis BGSC 4BD1
MALPLPLIGATGPTGNSGPIGPTGGHEGPVGPTGVTGPTGATGPQGPQGIRGIQGPRGTTGAQGIQGAIGGTGEQGITGPTGLQGAQGLIGNQGLIGDIGVQGLEGIQGATGPAGSQGIQGIQGIQGEIGERGQTGGQGMQGERGITGLSGVTGSQGPQGVQGIQGEQGATGIQGEDGFQGIQGITGEEGPQGAQGIQGEVGPTGSTGMQGAQGISGIKGITGAIGLQGPQGVQGIQGITGATGFQGIKGIRGITGATGSIGIQGSEGPPGGPTGTTGPIGPSSGVTGPAGPPGPPGGPTGPTGATGSTGVSGGIGPIGAQGVQGITGPTGPQGVRGAQGSQGVVGAVGVQGAQGPQGNQGITGPTGAEGSQGIQGTRGVTGPTGAEGSKGIQGIQGVIGPTGAQGMVGIQGIAGPAGVTGAEGAQGAQGIRGATGPAGAQGIQGVQGIQGETGAAGIQGPQGVQGIQGTTGLTGTQGAQGPQGVQGIIGPTGAIGLQGPQGLQGIMGPTGAQGVQGIQGEQGIIGPTGAQGIRGPQGNTGEVGITGPQGVQGAQGSQGPQGPQGNVGITGAMGETGATGATGATGPQGLQGFQGITGIQGITGTTGNTGATGPQGIQGIQGVQGLQGPSGVSGVIGASGSIGPVGAQGSQGPSGVVGPTGATGSAGSIGFLGIAGATGATGLPSGGGYFFSTSTSTIAANALIPINSGSTIFGSGVSLTNATTITLSTPGIYLISYYFQGDAIFGNETISVSLVLNGTQVAGSFIFYVTKGNFILEPAISNTMVIEVTSLNSTLSLQNGPLAIGHVTTLAGVITASLNILKIV

SEQ ID NO: 29589 - protein, 166 aa, Bacillus thuringiensis serovar huazhongensis BGSC 4BD1
MVSIVIELFNGFRVVPLAGPGIVKLTFVLTTAEKPIPTSEVIVPNTGRIPKPVTPVGPVIPIPVGPVTPMGPVIPIPVGPVTPVGPVIPIPVGPVTPVGPVIPIPVGPVTPVGPVIPIPVKPVAPVGPVIPVGPVGKVNGGIDGSVGPIKFGSRAGPCKILYSSFI

SEQ ID NO: 29590 - protein, 84 aa, Bacillus thuringiensis serovar huazhongensis BGSC 4BD1
MYSVSFSIVFVIQAISSSILNLTINDSIQFAIETRVSGGSGVRSTSARTDLLSLNQGDVLRVRIREATGDIIYSNASLVVLKVD

SEQ ID NO: 29591 - protein, 1062 aa, Bacillus thuringiensis serovar huazhongensis BGSC 4BD1
MTHEKYSMDWSYSNSLAKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNTNNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEGLTYGKYYFLETKTPNGYVGNKTKYPFEIKEHNKTLTFTVENTEVKGSVKLLKVDNEDISKKLEGAVFELKDESGKVVGKYKTDKNGEINVKDLAYGKYSFVEKASPNGYVLVKEQIVFEIKEHGKIIELLAVNHLIKGDLEITKVDVADGNNKLPNAEFTIYNEVGKEVVKGKTDDKGIAKFEKLPFGKYTYNETIAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSIKTTATNKADGGKEIHSKDSITIQDKVEYTNLVVGKEYTVKGKLMNKAINKPLLIDGKEVTAETKFTAKEKNGFVTLDFTFAGAEQQGREVVVFEDLLHEGQVIATHADINDVGQTVRFVEPSIKTTATNKADGSKELDVSKSVTIQDKVEYKDLIVGKEYVVKGKLMDKATKKPLLVDGKEVTVESKFTAKEKNGSITLDFILNASELQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 29592 - protein, 971 aa, Bacillus thuringiensis serovar huazhongensis BGSC 4BD1
MKGYSKKMLVGVSFASLMLGNFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERGYHDKCLPALKAIANNSNFKLGTLEQNRVVSSYGKLIGNASSDVETITSAAKIFKQYNDNFSTLVDNLSAGNAIYDIMQGVDYDIQSYLYDTRKEPKDTVWYQKIDSYINELSRFALMGTITEKNGWLINNGIYYTGRLGMFHNTGTKGLQVVTDAMKIYPYLGEQYFVAAEQIATNYGGKDANGNVVNLDQIREEGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTLEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKRVSDIAAEITAEAKLKNVSVKKNKSQFFNTFTLQGTYTGTTVKGEYEDWKTITQNVNDTLKRLSAKEWTGYKTVTAYFVNYRVNASGQFEYDVVFHGINTEEGAENKAPVAVINGPYSGNVNEAILFKSDGSKDEDGKITSYKWEFGDGAVSNEQNPIHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 29593 - protein, 97 aa, Bacillus thuringiensis serovar huazhongensis BGSC 4BD1
MSAGNTVFTAANAGNYYISYSINITASLLVSSRITINGAPLAGTINSPALATTSFSATIITTLAAGSAISLQLFGLLAVATLSTTTPGAVLTIIRLS

SEQ ID NO: 29594 - protein, 242 aa, Bacillus thuringiensis serovar huazhongensis BGSC 4BD1
MTGSTGPTGNTGSTGSTGATGSTGATGDTGATGSTGATGSTGATGNTGTTGITGVTGDIGPTGNTGSTGVTGSTGSTGSTGSTGPTGNTGATGETGPTGSTGTTGVSTTATYAFANNTSGSLISVLLSGTNIPLPNNQNIGPGITFSGGNTVFTVANAGNYYIAYTINLTAGLLVSSRITVNGSPLAGTINAPTVATGSFSATIIANLPAGAAISLQLFGLVAIATLSTATPGATLTIIRLS

SEQ ID NO: 29595 - protein, 431 aa, Bacillus thuringiensis serovar huazhongensis BGSC 4BD1; identical to SEQ ID NO: 26534

SEQ ID NO: 29596 - protein, 949 aa, Bacillus thuringiensis serovar huazhongensis BGSC 4BD1
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDARAFYKDKGKMQVVIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEGGKIVSYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 29597 - protein, 467 aa, Bacillus thuringiensis serovar huazhongensis BGSC 4BD1
MKKLVRGTIKMNKKFFKQLKKMATNKKGLSAAAVAVGIMGTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRMDFEPIGTVKHDGSAASNNLSHKINVPTDRSGYHVILAVWDVADTVNAFYNVIDVNLINNEKTDTEAPTQPSGVQVVKATSNSVELSWKPAIDNVGVKEYQVLRNGQLINTIVGTSVVDKKLSPNTGYTYTVKAVDAAGNISRESEALVVKTTVEKPDTEAPTQPKGLHSMGTTTNSIDLMWSPSEDNIDVNHYIVYREVGGVMKELGTANTTSFMDKDLQANTIYKYVVSAVDSAGNESMKSDALTIATKGQENTYEQWGEYKAYKKGDKVVHEGKVYEAVQSYQGNGDPNWIFALSLWNEVNK

SEQ ID NO: 29598 - protein, 450 aa, Bacillus thuringiensis serovar huazhongensis BGSC 4BD1
MERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVSVDHYIVYRESAGVMNKIGTAANTSFMDKDLKANTSYKYVVTAVDLAGNESSRSDVLNVTTKSEDSTYEKWDARKAYTKGDRVVHEGKVYEAVQDHQGNGDSNWIFALSLWKPFLNK

SEQ ID NO: 29599 - protein, 974 aa, Bacillus thuringiensis serovar huazhongensis BGSC 4BD1
MLYFWVEYINGGNVMNKNLKFTQMMIGISTMALSFGSIQTQVSAEETASYNILQMKPMGTETSKDEIVHATTADETLTFEERLKVGDFSQRPTLVMKRDESQLKQSYTLAELNKMPNSELIDTLSKISWNQITDLFQFNQDTKAFYQNKERMNVIINELGQRGKTFTKENSKGIETFVEVLRSAFYVGYYNNELSYLKERSFHDKCLPALKAIAKNPNFTLGTAEQDRVVAAYGKLIGNASSDTETVQYAVNVLKQYNDNLSTYVSNYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQIKTNYGGKDYSGNAVDLQKVREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTDNVVPRKSMISGLSSDPASRYTAKQTLFSKYGSWDFYKYSFALQSYLYNHQFETFEKLQDLIRANDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIVNMNGPYSGIVNEEIQFHSDGTESENGKIISYLWNFGDGTTSTEANPTHVYGEKGTYTVELTVKDSRGKESKEKTKVTVKQDPQTGGSLEEEKVLPFNTLVKGNLVTPDQTDVYTFNVTDPKEVDISVVNEQNIGMTWVLYHESDIQNYVACGEDEGNTIKGKFVAKPGKYYLNVYKFDDKNGEYSLFVK

SEQ ID NO: 29600 - protein, 172 aa, Bacillus thuringiensis serovar huazhongensis BGSC 4BD1; identical to SEQ ID NO: 28096

SEQ ID NO: 29601 - protein, 215 aa, Bacillus thuringiensis serovar huazhongensis BGSC 4BD1
MFYNRVITMALPSLNAISYLEVYQLDQRYLDKVLTLSQEFQKSLNIEDFSFDFQKAIEITDFYDNTFVTNSINHTIKKEGVSVGKMIDTIYFAVNNLLELSEHNNIFRSRVLNTITNAFLNLSHQENESYFFYYQKDNNQTSYRYHIFLAIQENNENLFLKIVPISIDVTINSNIEEIKILNTHDIRDFTVNIKAINLVFYDIDNPNLLKDFNRS

SEQ ID NO: 29602 - protein, 457 aa, Bacillus thuringiensis serovar huazhongensis BGSC 4BD1
MNNKFLFTNTRKRKKSINAAILAAGIIGITMVPENAYAHGFVEKPASRAALCSLSYGALNSNCGRIMYEPQSLETLKGFPQSGPIDGKIASAGGLFEGILDQQTSNRWYKNTIKGGLNTFTWKYTATHPTSKWHYYITKKGWDPNKPLTRADLEPIGTVEHDGSQAANNLTHTINVPTDRSGYHIILAVWDVSNTSNAFYNVIDVNLVNDENPDLEAPTQPTGLHAKKVTSSSIELNWNSSTDNVGVKEYQVLRNGKVIETVAGTSITDKELTANTDYTYTVKAIDIAGNMSGESQPLIVRTTEDVPDTEAPTQPTALHSMEVTSSSIDLMWSASNDNMEVDHYAIYRETSTGQMKVVGTSKTNSFMDKNLQSNTTYKYAVTAIDTSGNESIKSNTLTITTKELGSPYEQWNAYKAYTKGDKVEHKGKIYEAVQSYQGQGDPNWIFALSLWKEITNN

SEQ ID NO: 29603 - protein, 128 aa, Bacillus thuringiensis serovar israelensis ATCC 35646
MKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 29604 - protein, 100 aa, Bacillus thuringiensis serovar israelensis ATCC 35646
MKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 29605 - protein, 431 aa, Bacillus thuringiensis serovar israelensis ATCC 35646; identical to SEQ ID NO: 26534

SEQ ID NO: 29606 - protein, 893 aa, Bacillus thuringiensis serovar israelensis ATCC 35646; identical to SEQ ID NO: 29368

SEQ ID NO: 29607 - protein, 234 aa, Bacillus thuringiensis serovar israelensis ATCC 35646
MIGPENIGPTFPILPPIYIPTGETGPTGITGATGETGPTGITGPTGITGATGETGSTGITGATGETGSTGITGPIGITGATGETGPIGITGATGETGPTGITGSTGITGLTGVTGLTGETGPIGITGPTGITGPTGVTGATGPTGGIGPITTTNLLYYTFADGEKLIYTDTDGIPQYGTTNILSPSEVSYINLFVNGILQPQPLYEVSTGKLTLLDTQPPSQGSSIILQFIIIN

SEQ ID NO: 29608 - protein, 152 aa, Bacillus thuringiensis serovar israelensis ATCC 35646
MAVCMKKAKEIAKCVAVASVIMSGSFSLQATSAFADSKGTVENLQNGGKVYNSFKTTYDMKQNIKNSIKVSFIEDPYADKKIAIVTTDGSNIDAKYTVNSGYYNAGLKWPSAYHTEAEITSGDSAPVHKAAPVNTMTSAKVTSEVGYTLVEV

SEQ ID NO: 29609 - protein, 545 aa, Bacillus thuringiensis serovar israelensis ATCC 35646
MAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVPGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 29610 - protein, 188 aa, Bacillus thuringiensis serovar israelensis ATCC 35646; identical to SEQ ID NO: 29384

SEQ ID NO: 29611 - protein, 583 aa, Bacillus thuringiensis serovar israelensis ATCC 35646
MRHHKNCKKFGVALPLPLIGATGPTGNSGPVGPTGGHEGPVGPTGMTGPTGATGPQGPQGIRGIQGSRGTTGAQGIQGAVGDTGEQGITGPTGLQGAQGLIGNQGPIGDIGVQGLEGTQGATGPAGSQGIQGIQGIQGEVGERGQTGAQGIQGERGVTGVPGVTGSQGPQGVQGIQGEQGATGIQGEDGAQGIQGITGEQGHQGDQGAQGVVGPTGSTGIQGPQGISGIKGITGVTGPQGPQGVQGIQGVSGSTGFQGAKGVRGITGATGPQGIQGIQGVQGPIGPTGPTGPQGLQGITGQAGPTGPIGATGPTGETGPQGPQGIQGSQGEMGPTGATGPTGETGPQGLQGIQGPQGITGPTGATGPTGETGPQGLQGIQGLQGITGSTGATGQTGVTGATGPTGIQGIQGITGATGGTGVTGPTGATGPTGLTGATGSSAISTGGGYFFSTSTSTIAASANIPINSGSTVYGTGVSLTSATTVTVSTPGIYLVSYYFQGDATGGNEVVSVRLLLNRTQVTGSFIQNVTTSTVVLEPSISNTLLVNVASANSTFILQNGPLGVGHVTTIAGTITASLNVVRIL

SEQ ID NO: 29612 - protein, 410 aa, Bacillus thuringiensis serovar israelensis ATCC 35646
MQEGPTGPTGSTGPVGPTGPTGTGEGITGPPGPTGDPGPAGPQGVPGIQGEQGDPGPTGPQGVPGIQGEQGDPGPTGPQGVPGIQGEQGDPGPDGPQGVPGIQGEQGDPGPTGPVGPTGAGVTGPTGLPGPTGPGAGATGPTGPAGPTGPGGGATGPTGPTGPGGGATGPTGATGLQGPPGPAGPTGPQGNQGIQGEPGPEGPTGPQGNQGIQGPAGARGPTGPQGPQGIQGPAGARGPTGPQGNQGIQGPTGPQGPQGPQGPQGPVGPTLTANNIYVANPSTNINVVGSPGRNAPIPMTTTVTRNGTILTLASPGISVSTTGTYYIIAKGTIESPVNARAAIALALNGILIPQTSSLANLPFGSTPISGTQVMTYAIVNISASQVITVVNNDVENSVFGNVSIGVFRIG

SEQ ID NO: 29613 - protein, 375 aa, Bacillus thuringiensis serovar israelensis ATCC 35646
MSKFNKHNHCNHIPFPCAFPPFEPGVTGPTGPTGPLGPTGPAGTGEGITGPPGPQGPAGDTGPQGVPGIQGEIGDPGPTGPQGPPGIQGEPGDLGPTGPQGVPGIQGEPGDPGPDGPQGVPGIQGEPGDPGPTGPTGPAGATGAGATGPTGPAGIGTPGPTGPQGNPGIQGEPGPEGPTGPQGNPGIQGPPGPQGPTGPQGTQGPQGIPGTRGPTGAQGPQGIQGPPGSIGPTGPTGSVEPPIAVSALYESNTITVQNGERIPFTRVLAPSVGVTADTAARTITIQGANRRFSITLNIALASQNTTLPVNIQVNGPLGSIEGARIVAGNQLSLSYNRILTNNTVLSFVNVSGGPIVIGGAVSGSSTVSINIFTIG

SEQ ID NO: 29614 - protein, 971 aa, Bacillus thuringiensis serovar israelensis ATCC 35646
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIINKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVYNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFSNTFTLQGTYTGTAAKGEYEDWKIITQNVNDTLKRLSAKEWTGYKTVTAYFVNYRVNASGQFEYDVVFHGINTEEGAENKAPVAVINGPYSGNVNEAISFKSDASKDEDGKITSYKWEFGDGTVSNEKNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 29615 - protein, 165 aa, Bacillus thuringiensis serovar israelensis ATCC 35646
MFGVSACSSHDTSAKNEQKTSKKTENNELNRKVPQKELPTNVDSSDVYMSMGSAESLDVLGTGEVKAQGVFKVLDIAVYNHKEEPITLDINNFKLIDGFGREYHISNEYQSVLKAANISTFKFNIVNPNESSEGNIVFNVPKNTQGLTLKINNDKLDKELQLKVE

SEQ ID NO: 29616 - protein, 965 aa, Bacillus thuringiensis serovar israelensis ATCC 35646; identical to SEQ ID NO: 29366

SEQ ID NO: 29617 - protein, 162 aa, Bacillus thuringiensis serovar israelensis ATCC 35646
MEESKEEVKEPTKEVEEPTKEVKEPTKEVEESKEEVKEPTKEVEESKEEVKEPTKEVEEAKEEVKEPTKEVEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 29618 - protein, 128 aa, Bacillus thuringiensis serovar israelensis ATCC 35646
MTFVLTTAEKPIPTSEVIVPNTGRIPKPVAPVGPVIPIPVGPVTPVGPVIPIPAGPVTPVGPVIPIPVGPVTPVGPVIPIPVKPVAPVGPVIPVGPVGKVNGGIDGSVGPIKFGSRAGPCKVLYSSFI

SEQ ID NO: 29619 - protein, 254 aa, Bacillus thuringiensis serovar israelensis ATCC 35646
MTGPTGPSGSPGPTGLQGIQGIQGIPGPTGPQGSQGIQGIQGNPGPIGPIGPTGITGATGIQGIQGIQGNPGLIGPIGPTGPTGLQGIQGIQGIPGPTGLPGTAGATGPTGPTGLTVSGLSHYAYVFNTAAQVVALEAPILFNSHGRMTSGFTHTLGTSQLMVLNAGDYKISFSVSGVEPNQFTLFLNGAPVTSAVYGSGAGTQPNNGQTILALAAGDIITLNNHTSAAAVTLQTLAGGTQTNINASIVIEKLN

SEQ ID NO: 29620 - protein, 458 aa, Bacillus thuringiensis serovar israelensis ATCC 35646; identical to SEQ ID NO: 26537

SEQ ID NO: 29621 - protein, 507 aa, Bacillus thuringiensis serovar israelensis ATCC 35646
MVLCLIKKWWQWQLTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQPVTGVKEVTTKISEKDAIQKSMAYVGEASEQNLWAPTEKEFGYIVEEGMARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFEYWRLLMMAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWTARGISTN

SEQ ID NO: 29622 - protein, 183 aa, Bacillus thuringiensis serovar israelensis ATCC 35646; identical to SEQ ID NO: 26531

SEQ ID NO: 29623 - protein, 296 aa, Bacillus thuringiensis serovar israelensis ATCC 35646
MSNNNYSNGLNPDESLSASAFDPNLVGPTLPPIPPFTLPTGPTGPTGPTGPTGPTGGGTGITGPTGPTGDTGATGPTGPTGDTGATGLTGPTGDTGATGPTGPTGDTGATGPTGPTGDTGATGLTGPTGDTGATGPTGPTGATGPTGATGPTGATGPTGPSGLGLPAGLYAFNSGGISLDLGINDPVPFNTVGSQFGTAISQLDADTFVISETGFYKITVIAYTATVSLLGGLTIQVNGVPVPGTGSSLISLGAPIVIQAITQITTTPSLVEVIVTGLGLSLALGTSASIIIEKVA

SEQ ID NO: 29624 - protein, 746 aa, Bacillus thuringiensis serovar israelensis ATCC 35646
MGNKSKHKTKRILVATATLTIIASGMASSSDVFAEETQQQKSLSTSLQSEKSVKSENRIFTVPGKGDVEVLKQQERKSMAFSPYEPTGLYAKPNEQITINVEGNQDIEVYIGTYSYDASWREDSKIKSFTLKPGINTIQSPNGGMIYFYNKQQGGSIRTTITTGGTTTPFFELGKHTKQDLINMLDQYPSAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLHPNNDTIQKVAALGYPILTAEIWKGTDSNPIKPDMPNVNNILEGNQFAWSLKGIGDFEFAKVNLNKSTEEMQIDLKAGVPHNYFDSTYASIKVQNTSGKVVYNKEIYGNKQQNAESQKVSVKVGDYIELTHLEGVHRATITNVEKSIQESFGNKVVYEITKEGLKKVDKIVNPEPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQSHQGNGDPNWIFALSLWKPITIK

SEQ ID NO: 29625 - protein, 329 aa, Bacillus thuringiensis serovar israelensis ATCC 35646
MLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKKLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 29626 - protein, 648 aa, Bacillus thuringiensis serovar israelensis ATCC 35646
MIIPTSQAISHTFAYAQENIAKSQQQVAPFWNKNKDYPGESYVTYEGKIYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNIPGLGADLAAAITDVNKLKDAYKSVINTLHLTHMDFDIEGGLVAHPESIERRSKAIALLQKELKAEGKDVKIGYTLPVMPYGLTNDGLNVIQSAIKHDVDLNSVNIMTMDYGQQNQQMGQAAIDAINSLHGQLTNLYKGSIKDSDIWKMIAVTPMIGKNDTQNETFTLNNAKELFQFAKEKGIGEISMWSVYRDKKATESWQIGQATGDASGLPDVEDGAFSKLFSAFNSSTEIDVIAPTAPSNLRSVSKTTTTVELQWEASTDNIGVKEYEVYRDGKKVGTTKTTRYEDAGLQANTKYNYTIKATDAAGNKSKSSNEVSVTTKEENPEQIAPTAPTGLQASETTTNSVHLIWEESISNVGIKEYEIYRNGTKIATSPSTYYTDENLLASTEYRYMVKAIDTQGKVSVASNEIKITTKDTPSSEYKAWDSYAAYKKGDRVEHQGKIYEAVQSYQGYGDPNWIFSLALWKVIK

SEQ ID NO: 29627 - protein, 368 aa, Bacillus thuringiensis serovar israelensis ATCC 35646
MQLCITIHSVLFSCYDINVIRHISTKIKGSDCMKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 29628 - protein, 82 aa, Bacillus thuringiensis serovar israelensis ATCC 35646
MRELLVMLKRSYQMLLITMSTLLVAINFLFPFTKVSAEVIQREQYKMDWSYSHQYGKDVRTELLKNSSGQIAYCIWTTFTEW

SEQ ID NO: 29629 - protein, 635 aa, Bacillus thuringiensis serovar israelensis ATCC 35646
MFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSMYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYSKEVYGNTQQKAESKTVPVKVGNFIELTHLEGEERAILTNLDNNKRESFDKKVIYEVTKDGLKKVNQIVIPKPDTEAPTQPLGLYASDVTTNSVELKWNPSTDNVGVKEYQVLRDGQLIQTVQETQFTDQNLTANKEYKYTVKAVDAAGNISVQSDILPVTTKSQNVTYEKWDPKKAYTKGDKVEYQGKFYEAVQSYQGNGDPTWIFALSLWQPFKMI

SEQ ID NO: 29630 - protein, 733 aa, Bacillus thuringiensis serovar israelensis ATCC 35646
MVTATLSMFTIGITPSLEIFAEEQAQQQKVSVLKNEESVKVENRVFTVQGKGDVKALSHLDRRAASFSPFEPTGLYAKPNEEITIDVEGNNEITAYIGAFSYNRNSQGEELVKSFTLKPGTNTIRYEGGGMIYFYNKQENGTIRTTIQKGGTPVPYFELGKHTKQDLIDMLNQNPDSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSRYLVQENKNYDEISDVFVKLAMLWQLHLAYGEEFYPKLHQLYRDMPSNEIPQTDETKKQLFMITASKAAKQNLIPFFEKWGLRPNNDTIQKIASLGYQNLTAEIWESTDSNPIKPDTPYSSNVLEGSQFAWSLKGIGDFEFAKVNLNKSTEEMQIDLRAGVPHNYFDSTYASIKVQNTSGKVVYNKEVYGNKQQNAEQAKFQVKVGDFIEFTHLEGADRAIITNMEKNIQESFGNKAVYEITKEGLKKVDKIINPKPDTEAPTQPQGLYASNVTSTSVELKWNSSTDNVGVKEYQVLRDGQLIQTVQGTTFTDQNLTANKEYKYAVKAVDAAGNTSIQSNILPVKTKDQNVSYEKWNPKKAYTKGDKVEHQGTVYEAVQNHQGNGDPNWIFALSLWKPLILNF

SEQ ID NO: 29631 - protein, 625 aa, Bacillus thuringiensis serovar israelensis ATCC 35646
MKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLVNYVTHNKDGVSIHAGNDAFYGLGWNLSSIYRFGGVCGNISKFGTQVSQAFGVAAMPVGQPGHCALIWNNKPSSWNLGNDISGWGGSSRHDATVIPWSDNSPTNQVPYMLLFENAERDPVKLDQSERLRWLAKAMTSADNKIAIYKISTNILPINFLVWEDYVSLMLQNPNVTDAEWRELNNSIISAFANEQRPLKDLLTQIKSHVPNADDILEGKQFSWSLKGIGDFEFAKVNLNKSTEEMQIDLKAGVPHNYFDSTYASIKVQNTSGKVVYNKEVNGKNQQNAEQAKVSVKVGDFIEFTHLEGANRAIIKNMEKNIQESFGNKAVYEITKEGLKKVDNIVNPKPDTEAPTQPQGLYASNLTSNSVELKWNPSTDNVGIKEYQVLRDGQLIQTVQGTTFTDQNLTANKEYKYAVKAVDAAGNTSIQSNILLVKTKDQNVSYEKWDSRKAYTKGDKVEHQGKVYEAVQNHQGNGDPNWIFALALWNPLT

SEQ ID NO: 29632 - protein, 823 aa, Bacillus thuringiensis serovar israelensis ATCC 35646
MIPLNQASAEVINRERYQLDWAYSPQYGKDVRTELLKNASGQIAYCLVYGLKSPNGEDLPEAGKTDDVSYRVLMNGYPQKTPENLGVFNWKEAHYATQLALWNALGQISVDELQFKNAAVEKAAKNIIHAANQSQDTQDVWMNVIPTDKQEAQLNGEYFETTTYNVQTNAKKGTFHVEMNNAPQGTRIVTEQGEVKETFQLGEKFRIQVPKSSKSSELSLKVVSNLTNVHAIVYKGTSTIQDATVLLERSTEQISTDLQVFWKANGALKVMKVDENQKPLPGAVFEITNSNQQVTGTITADKNGIAEMGNLELGTYTVKEVKAPIGYVLDATPKPFEVKTGEVAVIEMKNVQIKGNIEIKKVSDTGKILPGVEFTVFKPEGKAVTKVTTNQEGIAKVNSLPFGKYYFQETKGLEGYLLNQTKYPFEVKEHNQTLTFEVKNDQVKGNVQLVKVDEDGKTKLEGAVFILADEKGKKISEHKTDKNGLIKIDNIPFGKYQFIEKTSPAGYVLVKEPIPFSITENGKTIELVAKNTKIRGSIEITKVDVADGNNKLPGAEFTIYNEQGQEVVKGKTNEQGIAKFNKLPAGKYTYKETLSPQGYVSHEETFSFEIKTDGEIIKHIVKNKKIEGSLEITKVDVADGNNKLPGAEFTIYNEQGQEVVKGKTNEQGIAKFEKLPAGKYTYKETFAPEGYLINEETFSFEIKTDGEIIKHVVADQKKEVPPTPETPQPEKPEQPKPQPEQPQPEKPQTPQVIEKPVPTPEKPQNIVKQPQPMKKQPKKVESHLPTTGGKAENPYWKWIGVTFVVLGSILAVYALRKRKNQEV

SEQ ID NO: 29633 - protein, 140 aa, Bacillus thuringiensis serovar israelensis/tochigiensis
NLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFA

SEQ ID NO: 29634 - protein, 168 aa, Bacillus thuringiensis serovar kurstaki str. T03a001
MWRKEYVKKVSQIVLIFGIAFSLSACTETKDSNESKQEDVQDKVYKIGETVDVDGLQVTIDSVKLGYTDYDEDKKKEEILGIIFKVENNSKKEIPFAFYEFEITDKKGTRFKEYNNPDSFISKKLAPEEKIQDIMLFDVAKENTYIATYRPEFTRENRTIKFELKPNK

SEQ ID NO: 29635 - protein, 949 aa, Bacillus thuringiensis serovar kurstaki str. T03a001
MALSLGALQTHAAAEEKVPYNVLKTKPVGIEKSVDEVGHISKVDETLSFQERLKVGDFSQRPASITKKTAVKQVKESYSMADLNKMNDRELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYHENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRLEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYKLSVK

SEQ ID NO: 29636 - protein, 573 aa, Bacillus thuringiensis serovar kurstaki str. T03a001
MQDEQGKVVTEVKTDKNGKAKISDLSVGKYKLVEKESLPGYKKLTEPVSFEIKKGMTEVLSLKVENEQLDKGSVEITKVDKDSQKVLEGVVFEVQDDKGKVVTEVKTDKNGKVKISDLSVGKYKLVEKESLPGYKQLTEPVSFEITKGMTEVLSLNIENEMVDTGNVEITKIDKDNKAPLAGVVFEVQDDKGKVVTKVTTDKAGKATVSDLSVGKYKLVEVESLPGYKKLEKPVPFEITKGMTKSLAFTVENEMVDTGNVEITKIDKDSKAPLENVVFEVRDSKGKVVAKVTTDKEGKANVSDLSVGKYKLVETKSLPGYKKLTEPVSFEITKGMTKVLSLKVENEQLDKGSVEIIKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPDPEKPGTPNPEKPGTPNPEKPGTPNPEKPGTPNPEKPGTPNPEKPGTPNPEKPGTPDPEKPGTPNPEKPEKELPKTGQKMPVEPYMGALLVMMSFGLLILGRKQQR

SEQ ID NO: 29637 - protein, 336 aa, Bacillus thuringiensis serovar kurstaki str. T03a001; identical to SEQ ID NO: 27051

SEQ ID NO: 29638 - protein, 893 aa, Bacillus thuringiensis serovar kurstaki str. T03a001; identical to SEQ ID NO: 27049

SEQ ID NO: 29639 - protein, 563 aa, Bacillus thuringiensis serovar kurstaki str. T03a001
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 29640 - protein, 455 aa, Bacillus thuringiensis serovar kurstaki str. T03a001; identical to SEQ ID NO: 27050

SEQ ID NO: 29641 - protein, 862 aa, Bacillus thuringiensis serovar kurstaki str. T03a001
MTITCNGLQIQAETKEKNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQTYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWYRNIDNFINEINRFALLGTVTNKNGWLINNGIYYAGRLGKLHSTPTKGQQVATDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPTKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 29642 - protein, 974 aa, Bacillus thuringiensis serovar kurstaki str. T03a001
MLYFWVEYINGGNVMNKNLKFTQMMIGISTMALSFGSIQTQVSAEEKAPYNTLQMKPIGTETLKDEIAHATKADGTLTFEERLKVGDFSQRPTSVMKHDERQLKQSYTLAELNKMPDSQFIDTLSRVSWNQITDLFQFNQDTKAFYQNKERMNVIIDELGQRGTSFTKEDSKGIETFVEVLRSAFYVGYFNNEVGYLKERSFHDKCLPSLKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEISRIALIRNLTTENSWLINNGIYYAGRLGKFHSNPNKGLEVITQAMNMYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTIVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQTGWSGYKTVTAYFVNYRVNAANQFEYDIVFHGVATEEKEKTTTIVNMNGPYSGIVNEGIQFHSDGTESENGKIISYLWNFGDGTTSTEANPTHVYGEKGTYTVELTVKDSRGKESKEQTKVTVKQDPQTGESLEEEKVLPFNKLVKGNLIAPDQTDVYTFDVTVPKEVDISVVNEQNIGMTWVLYHESDMQNYVVCGEDEGNAIKGKFVAKPGKYYLNVYKFDDNTGEYSLLIK

SEQ ID NO: 29643 - protein, 380 aa, Bacillus thuringiensis serovar kurstaki str. T03a001
MHMKEKRYKNMKTKQTIAASTLALAMIAGANSAHAEVNDTTPQQSTGDRLAEIKQHKQELDAKLQQQKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGGVLLLTRNKIKTLFSK

SEQ ID NO: 29644 - protein, 71 aa, Bacillus thuringiensis serovar kurstaki str. T03a001
MLLNGTQLTGSFIQNVTTSTVVIEPAISNTLLVNVTSANSTLILQNGPLGVGHVTTIAGAITASLNIVRIL

SEQ ID NO: 29645 - protein, 450 aa, Bacillus thuringiensis serovar kurstaki str. T03a001
MERLRTSKKGIGACVLAAGMTAITMTPQSAYAHGFVEKPSSRAALCSQNYGALNLNCGNVMYEPQSLEAPKGFPDSGPIDGEIASAGGLFGGILDQQTSNRWFKNTIKGGVNTFTWKYTAPHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVSGTTFIDKKLKADTEYTYTIKALDSAGNISKESEKLKVKTTHTIPDIEAPTQPKGLHSMGTTATTVNLMWSPSEDNVGVDHYIVYRESAGVMNKIGTAANTSFMDKDLKANTSYKYVVTAVDLAGNESSRSDVLNVTTKLEDPAYEKWDARKAYTKGDRVVHEGKVYEAVQNHQGNGDSNWIFALSLWKPVLNK

SEQ ID NO: 29646 - protein, 1062 aa, Bacillus thuringiensis serovar kurstaki str. T03a001
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTQVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKVIELLAVNHLIKGDLEITKVDVADGNNKLPNAEFTIYNEAGKEVVKGKTDDKGIAKFEKLPFGKYTYKETVAPNGYVLNEETFSFEIKENDQIIKHIVKDEKIPSIKTTATDKTDGTKEMHTSKSVTIQDKVEYKDLQVGKEYTLKGKLMNKETNKPFVVNGKEVTVETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEHPNSGKNTPTPEQPNEQVKEQPQLKKEIQSKIGWLPQTGTNLTSWISMAAGALLLIVGGVIFLKRKNA

SEQ ID NO: 29647 - protein, 971 aa, Bacillus thuringiensis serovar kurstaki str. T03a001; identical to SEQ ID NO: 27048

SEQ ID NO: 29648 - protein, 594 aa, Bacillus thuringiensis serovar kurstaki str. T03a001
MSSWLNNTNGYCSCNNQNGVHVDSCCFSCDGTVPKLGPTGPTGATGSTGATGSTGPTGATGSTGPTGATGATGATGSTGATGPTGSTGPTGSTGPTGSTGPTGSTGPTGATGSTGSTGPTGPTGPTGSTGPTGATGPTGATGPTGSTGPTGSTGPTGSTGPTGSTGSTGPTGSTGPTGSTGSTGATGSTGSTGPTGATGPTGSTGATGPTGATGSTGSTGSTGPTGATGSTGVTGPTGATGSTGATGPTGSTGSTGPTGATGPTGATGPTGSTGSTGSTGSTGPTGATGPTGSTGPIGATGPTGATGPTGSTGPTGATGSTGPTGATGPTGSTGATGSTGSTGATGPTGATGPTGSTGPTGATGSTGSTGPTGPTGATGPTGSTGATGSTGSTGSTGPTGSTGSTGSTGPTGSTGSTGPTGSTGPTGSTGSTGSTGPTGATGPTGSTGSTGPTGATGTSITATYAFANNTSGTAISVVLGGTNVPLPNNQNIGPGITVSGGNTVFTVANAGNYYISYTINITASLLVSSRITINGGALAGTINAPAVATTSFSATIITTLAAGDAISLQLFGLLAVATLSTTTPGAVLTIIRLS

SEQ ID NO: 29649 - protein, 140 aa, Bacillus thuringiensis serovar kurstaki str. T03a001
MTGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAIATLSTATPGATLTIIRLS

SEQ ID NO: 29650 - protein, 554 aa, Bacillus thuringiensis serovar kurstaki str. T03a001; identical to SEQ ID NO: 27043

SEQ ID NO: 29651 - protein, 68 aa, Bacillus thuringiensis serovar kurstaki str. T03a001; identical to SEQ ID NO: 28052

SEQ ID NO: 29652 - protein, 431 aa, Bacillus thuringiensis serovar kurstaki str. T03a001; identical to SEQ ID NO: 26534

SEQ ID NO: 29653 - protein, 726 aa, Bacillus thuringiensis serovar kurstaki str. T03a001
MLATGMIFSSDVFAEQKEQQKNLSTSLQKEKSVKSENRTFTVPGKGDVEVLKQQERKSMAFSPYEPTGLYAKPNEQITINVEGNQDIQVYIGTYSYDASWREDSKIKSFTLKPGINTIQSPSGGMIYFYNKQQGGTIRTTITTGGTTTPFFELGKHTKQDLINMLDQYPNAHAVELKGERVLITASLARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSGELPQTDDNKKQLFMISASKVAKQNLIPFFEKWGLRPNNDTIQKVAALGYPILTAEIWKSTDSNPIKPDMPNVNNILEGNQFAWSLKGISDFEFAKINFNKSTEEMQVDLKAGVPHHYFNETYASIKVQNASGKVVYNKDIYGNKQQNAESQKVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 29654 - protein, 503 aa, Bacillus thuringiensis serovar kurstaki str. T03a001; identical to SEQ ID NO: 26634

SEQ ID NO: 29655 - protein, 348 aa, Bacillus thuringiensis serovar kurstaki str. T03a001; identical to SEQ ID NO: 27518

SEQ ID NO: 29656 - protein, 338 aa, Bacillus thuringiensis serovar monterrey BGSC 4AJ1; identical to SEQ ID NO: 26105

SEQ ID NO: 29657 - protein, 72 aa, Bacillus thuringiensis serovar monterrey BGSC 4AJ1
MDQEPKGKNQVVENEGRKADTLNKQYTNKPEEGKKSLPSTGGEASTSTLLSGITLVLSALSMFVFRKRLFKK

SEQ ID NO: 29658 - protein, 949 aa, Bacillus thuringiensis serovar monterrey BGSC 4AJ1
MALSLGAIQTHVSAEEKVPYNVLHSKPVGIEKPVDEIGHVSKAEETLSFQERLKVGDFSQRPASITNKVTVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVASAKNIDISVLNEYGIGMTWVLHHESDMQNYAAYGQINGNHIEANFNAKPGKYYLYVYKYDNGEGTYELSVK

SEQ ID NO: 29659 - protein, 209 aa, Bacillus thuringiensis serovar monterrey BGSC 4AJ1
MLKKFTTCILGGALVFNLSGCGNTSDKTSSESKETNSKQEEKNVQTTDEAKTKENTKQKNTEQTKEKSKIKEKEYAVNKDFHTPKFDVTVKRVVERDKVGKESTGFQKPEDGHVFIVVEAEGKNITSEPMKLAFLPSVDLVDENDNAYQSDVWAASSYDVEKGETSSITKELKPGEVKRQNKVYVINKEKFDTGKWYVVVNNEYKEQIK

SEQ ID NO: 29660 - protein, 174 aa, Bacillus thuringiensis serovar monterrey BGSC 4AJ1
MEKFMKKLLASATAFTLLTVGYSSAAFAEKNPNDKDCGHFKNKQEVMEFWHSNGYSATNDPHDLDRDNDGLPCEVKKGDYDQFLASKQPTKKDENKPQEQVKQENTKQENTQQNNQATNNKQEQTKQTAVKAETKKQGEKLPNTASNGVTMMLASAGLVLAGSILIFRRKKTNA

SEQ ID NO: 29661 - protein, 336 aa, Bacillus thuringiensis serovar monterrey BGSC 4AJ1; identical to SEQ ID NO: 26393

SEQ ID NO: 29662 - protein, 503 aa, Bacillus thuringiensis serovar monterrey BGSC 4AJ1; identical to SEQ ID NO: 28484

SEQ ID NO: 29663 - protein, 412 aa, Bacillus thuringiensis serovar monterrey BGSC 4AJ1; identical to SEQ ID NO: 26362

SEQ ID NO: 29664 - protein, 455 aa, Bacillus thuringiensis serovar monterrey BGSC 4AJ1; identical to SEQ ID NO: 28478

SEQ ID NO: 29665 - protein, 372 aa, Bacillus thuringiensis serovar monterrey BGSC 4AJ1
MKTKQTIVASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 29666 - protein, 39 aa, Bacillus thuringiensis serovar monterrey BGSC 4AJ1; identical to SEQ ID NO: 26665

SEQ ID NO: 29667 - protein, 971 aa, Bacillus thuringiensis serovar monterrey BGSC 4AJ1; identical to SEQ ID NO: 28490

SEQ ID NO: 29668 - protein, 774 aa, Bacillus thuringiensis serovar monterrey BGSC 4AJ1
MLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADIIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 29669 - protein, 230 aa, Bacillus thuringiensis serovar monterrey BGSC 4AJ1
MTGSTGPTGNTGATGETGVTGSTGPTGETGVTGSTGPTGNTGATGETGVTGSTGPTGSTGATGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 29670 - protein, 148 aa, Bacillus thuringiensis serovar monterrey BGSC 4AJ1
MKKKLLPICAMALLTMGYSSVASADTGTVTKEEAMQLQQDKAKKEAAIKEQQKIEEEKKRIAQEQLKNDMAKKEEAIKAQQKSEEGKKEAAQVQQKNAATKKEEAKPAVQGEKLPNTASNNVVMMGLSACLVAIGTLFGLKRRNKVKA

SEQ ID NO: 29671 - protein, 431 aa, Bacillus thuringiensis serovar monterrey BGSC 4AJ1; identical to SEQ ID NO: 26106

SEQ ID NO: 29672 - protein, 185 aa, Bacillus thuringiensis serovar monterrey BGSC 4AJ1
MTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIESSSGGDNKPITPPNKEEKPGKETSEELENGNPKTQTNKQQDDRNTGKELPNTGHKNDSTQTVGIILLLAGLLSVLATKRKKYY

SEQ ID NO: 29673 - protein, 746 aa, Bacillus thuringiensis serovar monterrey BGSC 4AJ1
MGNKSKHKTKRILVATATLTILASGMASSSDVFAEETQQQKKLSTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKLDEATRIQDKVAGLSEEQADKHYIHYVEENHSPDYYMYAYPYRTAYVGDAIQYVLDINKFIKDGWGPWHEAGHLRQQWPWNFYNMTEVQNNIYSLSVEKAFNQPSNLEKSGIYPKAFQYLEQTNKNYDEISDVFVKLVMLWQLQLAYGEDFHPKLHQLYRDMPSSELPQTDETKKQLFMISASKVAKQNLIPFFEKWGLRPNNDTIQKVAALGYPILTAEIWKGTDSNPIKPDMPNGNNILEGNKFAWSLKGISDFEFAKVNFNKSTEEMQIDLKEGIPHHYFNETYASIKVQNASGTVVYKKDIYGNKQQNAELQKVPVKVGDYIELTHLEGVHRATFMNVDNSKQESFGKKAIYEVTKDGLKTVNQIVNPKPDTEAPTQPQGLYASNVSSNSVELKWNPSTDNVGVKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDTNWIFALSLWKPITIK

SEQ ID NO: 29674 - protein, 965 aa, Bacillus thuringiensis serovar monterrey BGSC 4AJ1
MKLKSTFKCLTITAVLSQITVYPTTSYAENIDRTINTDKSKEEQNSQGLLGYHFKDNQFEKLSYIEVGIKNKEEEKKQRMKRSIEDEKNLSIQSVRWLGRLVVPETGEYTLSTSFDQHVILQINGETVLNKGKTVKSVSLEKDKAYEVKIEYQNTENIETDLQLFWSINGQDKKLIPHQNIVSPDFSKKENLPEDKLNTALIPNSNLFNGKASSTNMEDTDQDGIPNEWEEKGYTFKNQQIVKWDDSYLSQGYKKYLSNPYKARTIADPYTDFEKVSGHMPAATKEDARDPLVAAYPAVGVGMENLLFSKNENVTEGSSGTMSKSVTDTNTNTNNVDLSAKLGWNDKGFGFEFTPKYSHTWTNSTAVQNSESESWSSQVGINSAESAYLNANVRYYNAGTAPIYDLKPTTNFVLQNSGKSLATITAGPNQIGNSLGPGDTYPKVGQAPISLDKANDAGTVKIPINKDYLDALQSNSEALDLETTQNKGQYGVLDATGQLITDSSKQWDPVRTNIDSVSGSLTLNLGSSKESLERRVAAKNDDDPEDKTPEITIGEAIKKAFNAKEKDGRLYYVNSNGENVFLDESSVNLIGDENTKKDIEQQLEHMEDKKVYNAKWKRGMKITIHVPTSYYDFEKSGDSQWYNTYQDNGGYTGEKTGRINPGSNGYAIKDFTLKPYTSYTARAYVKASSSETDAVFYVDSDINSIGKGIKQNIKATGDKWKLVEMSFNTGSNPELFKKVGFKNQGNVQLQFDDVSVTEWKTEENLEKTHSMENWDVDPSKQYVKGGTFSHVPNSKIRYQWKINDNWEKIIPAPPVDNYGKRVMEKNFNFNDHVELYAVDEHNDYLKVKVAEHNKGDAITEDVLKSSHQFSTWIKSKAPGGGSYTDGWYFERIPDGVLHCVTKYKVSINGGKPVTRDRYNPDKNGRMEVNLLEYNGGRGVKEGSRIEAWAILSNGKEAKVLDKKTS

SEQ ID NO: 29675 - protein, 174 aa, Bacillus thuringiensis serovar monterrey BGSC 4AJ1
MYKKMGTIALTGALAFSLAACGETEVKEVSKNDAPKQEQKKEDKDASKVYKTGETVEVNGLQITFNSAKFVEPNEYSKAEKGKVLEIDFAAKNNGKKDAYIGTEELKIADANGNQFKEYFGADNAFMNENIGPGNQITGKMYFDVAESDKYTGTYKPNFTLDDKSVKFEFTPAK

SEQ ID NO: 29676 - protein, 969 aa, Bacillus thuringiensis serovar monterrey BGSC 4AJ1
MEYINGGNVMNKNLKFTQMIIGISTMALSFGSIQTQVSAEETASYNILQMKLMGTETSKDEIVHATTADETLTFEERLKVGDFSQRPTLVMKRDESQLKQSYTLAELNKMPDSELIDTLSNISWNQITDLFQFNQDTKAFYQNKERMNIIIDELGQRGSTFTKDNSKGIETFVEVLRSAFYVGYYNNELSYLKERSFHDKCLPALKAIAKNPNFTLGTAEQDRVVAAYGKLIGNASSDTETVQYAVNVLKQYNDNLTTYVSDYAKGQAVYEIVKGIDYDIQSYLQDTSKQSNETMWYGKIDNFINEVNRIALVGNITNENSWLINNGIYYAGRLGKFHSNPYKGLEVITQAMSLYPRLSGPYFVAVEQIKTNYGGKDYSGNAVNLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIINMNGPYSGIVNEEIQFHSDGTTSENGKVTSYLWNFGDGTTSTEANPTHVYGEKGTYTVELTVKDSRGKESKDQTKVTIKQDPQTGESHEEEKVLPFNTLVKGNLITPDQTDVYTFNVTNPKEVDISVVNEQNIGMTWVLYHESDMQNYVACGEDEGNTIKGKFEAKPGKYYLNVYKFDDKNGEYSLFVK

SEQ ID NO: 29677 - protein, 203 aa, Bacillus thuringiensis serovar monterrey BGSC 4AJ1
MKKPFYKKWWFWVIVVIIVLGAYGNSSKDTEETKTASTEPKQEAKQETKKDEPKKDEAKKEEPKKEEPKKELSKEGESSKVKIAVGSVESTDSVGGQYLSEKAQGVFKVVEISITNNQKDAITVDANSFKLVDNQDREFKYSTQAQTAFDVGNGGKSDFFLKQLNPGLTQTGKIIFDVPADAQGLVLKARGGMMGKEIKLKVE

SEQ ID NO: 29678 - protein, 456 aa, Bacillus thuringiensis serovar monterrey BGSC 4AJ1
MNKKILGQFRKMATNKKGLSAAAVAVGIMSTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRADFEPIGTVKHDGSKASNNLSHKINVPTDRSGYHVILAVWDVADTVNAFYNVIDVNLINDEKPDKEAPTQPSELQVIKATSNSVELNWKPVTDNEGVKEYQVLRNGELINTVVGTSVIDKKLNPNTEYTYTVRAVDAAGNISEESEALVIKTTEEKPDTEAPTQPKGLHSMGTTTSSIDLMWSPSEDNIDVSHYIVYREVGGVMKEIGTANTTSFMDKDLQANTAYKYVVSAVDTSGNESMKSDAITVTTKGQENSYEQWDARKAYKVGDRVVHEDKVYEAVQSYQGNGDPNWIFALSLWKEVN

SEQ ID NO: 29679 - protein, 130 aa, Bacillus thuringiensis serovar monterrey BGSC 4AJ1
MNWSTSTSYDQPDSKTVLETDIANKVQWRIPFIFTMDLGYGLYNKESYDSIYRNQLFMKLRNAATWAKDNFISIDEMSDLASCGFSPGMIVVIIADKSEDISTFKITYNRNSHDYRMDWKSFFKVLVQKS

SEQ ID NO: 29680 - protein, 78 aa, Bacillus thuringiensis serovar monterrey BGSC 4AJ1
MSAVIKWASSYNIGMELTNENSQFYKVSPINTIDTKTITSSIGYNIGGEIKVSDKADGGSCFKIKFDQIDTNNLDKRL

SEQ ID NO: 29681 - protein, 746 aa, Bacillus thuringiensis serovar monterrey BGSC 4AJ1
MKRGQKRKTQNLVMVTATLSMFTIGITPSLEIFAEEQAQQQKVSVLKNEESVKVENRVFTVQGKGDVKALSHLDRRAASFSPFEPTGLYAKPNEEITIDVEGNNEITAYIGAFSYNRNSQGEELVKSFTLKPGTNTIRYEGGGMIYFYNKQENGTIRTTIQKGGTPVPYFELGKHTKQDLINMLNQNPNSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSRYLVQENKNYDEISDVFVKLAMLWQLHLAYGEEFYPKLHQLYRDMPSNEIPQTDETKKQLFMITASKAAKQNLIPFFEKWGLRPNNDTIQKIASLGYPNLTAEIWESTDSNPIKPDTPNSSNALEGSQFAWSLKGIGDFEFAKVNLNKSTEEMQIDLKAGVPHNYFDSTYASIKVQNTSGKVVYNKEIYGNQQQNAEQAKFPVKVGDFIEFTHLEGAGRAIITNMEKNIQESFGFKVVYEITKEGLKKVDKIVNPKPDTEAPTQPQGLYASNVASNSLELKWNPSTDNVGVKEYQVLRDGQLIQTVQGTTFTDQNLTANKEYKYAVKAVDAAGNTSIQSNILPVKTKDQNVSYEKWDPRKAYTKGDKVEHQGKVYEAVQNHQGNGDPNWIFALSLWKPINLNF

SEQ ID NO: 29682 - protein, 762 aa, Bacillus thuringiensis serovar monterrey BGSC 4AJ1
MQQSKVKNKKGEIILKRISSLLLTMPIILGSIATIPHTKVSAETMSFNQETFTLETLNQQTDQAIANGNFEAHLKNLTAYLNGNVGGTTEENLKKKLADPVFASALAQWQFISQSGATTMSTFAKKDADHQKFLGWAMKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLIDYVTHNKDGVSIHAGNDAFYGLGWNLSSIYRFGGVCGNISKFGTQVSQAFGVAAMPVGQPGHCALIWNNKPYSWNLGNDISGWSESSRHDATVIPWSDNSPTNQAPYMLLFENAERDPVKLDQSERLRWLAKAMTSTDNKIAIYKISTNILPINFLVWKDYVSLMLQNPNVTDAEWKELNNSIISVFANEPRPMVDLLTQIKNHVPNTDDILEGDQFAWSLKGIGDFEFAKVNFNKTTEEMQINLKAGVPHNYFDSTYASIKVQNTSGKVVYNKEVYGNKQQNDETQKVPVKIGDFIELTHLEGRERAILINLDNNKRESFDKKAMYEVTKDGLKKVNQIVNPKPDTEAPTQPQGLYASNLTSNSVEIKWNPSTDNVGIKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDPNWIFALALWNPLT

SEQ ID NO: 29683 - protein, 662 aa, Bacillus thuringiensis serovar monterrey BGSC 4AJ1
MFNQRTRRGVKKILAITAASTMFSMFGSSISNIEAASHTNAPGVYVTPKNSVSSDIISIDWSPVQTAPYTYWAVHNWNQGGEAGGYAGFQQQSGFDESGKRTLHFAVWDPISSKEAIKAEYVSPTSVASSFGGEGTGLKIQTTYDWKNYNWYRMTMRSWQENGHTKFGQWLKDVSKNQWKLIGIMDFPVPNVTFNYGQMLFQEDWAGNGQDVREARVKNGYGRNISDKKWVSWNTQSIDGQEPLNNNWDGGATSEYLWFKAGGNSQSTIGTGKTFTLNQPSQPEIGKLDYDIKSMYYENEKLNISWQLKESSTPQFKGKIEIYNNENMTGQPINVIDDIKSYQNGISQSISLPTNAYAKIILTDIFDQTVEKKVQIKNESPNILEGDKFAWSMKGIGDFEFAKINLNKSTEELQVNLIAGTPHNYFDSTYASIKVQDTSGKVVYNKEVYGNTRQNAESKTVPVKVGDFIELTHLEGGERATLTNLDNNKRESFDKKVIYEVTKDGLKKVNQIINPKPDTESPTQPQGLYASNVASDRVELKWNPSTDNVGVKEYQVLRDGQLIQTVQGTMFTDQNLTANKEYKYTVKAVDAAGNISVQSNILTVTTKSQNVTYEKWDPKKAYTKGDKVEYQGKFYEAVQSYQGNGDPTWIFALSLWQPFNMK

SEQ ID NO: 29684 - protein, 770 aa, Bacillus thuringiensis serovar monterrey BGSC 4AJ1
MGSFSLNAVAETEESAKMISNWKRVLVGEPFTNNDAILKNIVLDKEKDLQDNVLSNLNKENESPSLFKNLPDWKQNSAQITETVKNIEKMAVLYQTPNSIYYQKDTLQKDIMYAIEYFYNQMYNEKIKNTYGNWWDWEIGTPQSYNNILVLMFDDLTEVELSKFIMAVDRFVPDPTKRLNGIKETGANLLDKSFIVMVRGILNNNNNKIQLGIDATNDVYKIVQNGDGFYQDGSFIQHTYNPYTGGYGEVLLARSADIHELFSGTDRLTNVQGIKKLYTYIETTYLPVMKQGEVFDMTRGRGMSRQNSSSSIVGRNILYEILVISSQNQDLSYRGKYARYVKEAIFQHNDSESYYNGLSIHKTQTFQRLMSDSSIKPDFGVRDTNNMLSAMNQMTHQKKDFAAGLSLFGKQISSFEYGNGENMKGFYMGTGMLYLYNNDLGQYDNDYWATIDMTRLPGTTTDHKLGNLIDWKNYNNPKSWSGGVSDGRIGSASMYYTMQNVTGSSLEAKKSWFFLKDKIVATAAGINSKENADTETIVENRRLEKDGSNLLKVEGTEVIFDQGILFKGASWAHLKGKNNQSDIGYVFPQSENIYAEKKERSGKWSDVNKGGSGDQVSNMFATLSIPHGKSPSGGEYVYVILPGKNQEETSTYANEMDVSILSNTPTQQVIYDDADDIWMGNFYEIGKVNEVEAKTRGAIAINYKDNGVKVVMADPMKEQAKVIFIIPKKIGYKVAEKDEEITVKEDANSWIIEMDSSDKSGKSSQVYFEQ

SEQ ID NO: 29685 - protein, 67 aa, Bacillus thuringiensis serovar monterrey BGSC 4AJ1; identical to SEQ ID NO: 29497

SEQ ID NO: 29686 - protein, 667 aa, Bacillus thuringiensis serovar monterrey BGSC 4AJ1
MIIKKYPFRTLAKTAVALTMIIPTSLAISHPFAYAQENIAESQQQVAPFWNKNKDYPGESYVTYEGKVYHSLYWANAGTLPTQQFSGWELYTGSEYIPDNSDPNDLFGEGITWPSHVFAPYVDNGMNPQNLLKYAQETNTSFFTLSFIVADKNGNPVWGGSHAPIGDGNLDDQIKQIRKIGGDVKVSFGGANAGNIPGLGADLAAAITDVNKLKDAYKSVINTLHLTHMDFDIEGALVAHPESIERRSKAIALLQKELKAEGKDVKIGYTLPVMPYGLTNDGINVIQSAIKHDVDLNSINIMTMDYGQQNQQMGQAAIDAINSLHEQLTNLYKDTIKDSDIWKMIAVTPMIGKNDTQNETFTLNNAKELFQFAKEKGIGEISMWSVYRDKKATESWQIGEATADASGLPDIDDGAFSKLFSAFNSSTEIDVIAPTAPSNLRSVNQTTTTVELQWEASTDNVGVKEYEVYRDGKKVGTTKTTRYEDTGLQPNTKYNFTIKAVDAAGNKSKSSNEVSVTTKEKNPEQVAPTAPTGLQASETTTNSVHLIWEKSTSNVGIKEYEIYRNGTKIGTSPSAHYTDENLLASTEYRYMVKAIDTQGKVSVASNEIKITTKDKPSSEYKAWDSYAAYKKGDRVEHQGKIYEAVQNYQGYGDPNWIFSLALWKVIK

SEQ ID NO: 29687 - protein, 163 aa, Bacillus thuringiensis serovar pakistani str. T13001; identical to SEQ ID NO: 26509

SEQ ID NO: 29688 - protein, 176 aa, Bacillus thuringiensis serovar pakistani str. T13001; identical to SEQ ID NO: 26630

SEQ ID NO: 29689 - protein, 336 aa, Bacillus thuringiensis serovar pakistani str. T13001; identical to SEQ ID NO: 26633

SEQ ID NO: 29690 - protein, 179 aa, Bacillus thuringiensis serovar pakistani str. T13001; identical to SEQ ID NO: 26496

SEQ ID NO: 29691 - protein, 503 aa, Bacillus thuringiensis serovar pakistani str. T13001; identical to SEQ ID NO: 28309

SEQ ID NO: 29692 - protein, 455 aa, Bacillus thuringiensis serovar pakistani str. T13001; identical to SEQ ID NO: 28311

SEQ ID NO: 29693 - protein, 878 aa, Bacillus thuringiensis serovar pakistani str. T13001; identical to SEQ ID NO: 28308

SEQ ID NO: 29694 - protein, 380 aa, Bacillus thuringiensis serovar pakistani str. T13001
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGILLLTRNKIKTLFSK

SEQ ID NO: 29695 - protein, 71 aa, Bacillus thuringiensis serovar pakistani str. T13001
MLLNGTQLTGSFIQNVTTSTVVIEPAISNTLLVNVTSANSTLILRNGPLGVGHVTTIAGAITASLNVVRIL

SEQ ID NO: 29696 - protein, 138 aa, Bacillus thuringiensis serovar pakistani str. T13001
MVSIVIELFNGFRVVPLAGPGMVKLIFVLTTAEKPIPTSEVIVPNMGRIPKPVAPVGPVIPIPVGPVTPVGPVIPIPVGPVTPVGPVIPIPVKPVAPVGPVIPVGPVGNVNGGIDGSVGPIKFGSRAGPCKILYSSFI

SEQ ID NO: 29697 - protein, 84 aa, Bacillus thuringiensis serovar pakistani str. T13001; identical to SEQ ID NO: 27275

SEQ ID NO: 29698 - protein, 646 aa, Bacillus thuringiensis serovar pakistani str. T13001
MAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDISKSVTIQDKVEYKDLIAGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQQNSDKNTPTPEQPNEQVKEQPQPKQEIQSKIGWLPQTGTNLTSWISMVAGALLLIVGGVIFLKRKNA

SEQ ID NO: 29699 - protein, 971 aa, Bacillus thuringiensis serovar pakistani str. T13001; identical to SEQ ID NO: 28301

SEQ ID NO: 29700 - protein, 779 aa, Bacillus thuringiensis serovar pakistani str. T13001
MLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANANRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTGNGENPTPPTEEGNNGNEPKQDGNNTESGQTTTDDQNTKETTTVSENKEAEKDERDLPKTGASIASTIGAGLAFVGAGLLLLFRRKKANR

SEQ ID NO: 29701 - protein, 311 aa, Bacillus thuringiensis serovar pakistani str. T13001
MIALKRPNVKEVINMSSWSNNVNGYCGCNNQNGVHVDSCCFSCDGTVPKVGPTGPTGATGATGPTGATGVTGDTGPTGATGITGATGPTGATGITGATGPTGATGITGATGPTGATGITGATGPTGATGSTGATGATGVTGDTGPTGITGATGPTGATGVTGATGATGPTGATGTSITATYAFANNTSGTAISVLLGGTNVPLPNNQNIGPGITVSGGNTVFTAANAGNYYISYSINITAALLVSSRITINGAPLAGTINSPALATTSFSATIITTLAAGSAISLQLFGLLAVATLSTTTPGAVLTIIRLS

SEQ ID NO: 29702 - protein, 48 aa, Bacillus thuringiensis serovar pakistani str. T13001
MATGSFSATIIANLPAGAAVSLQLFGVVALATLSTATPGATLTIIRLS

SEQ ID NO: 29703 - protein, 68 aa, Bacillus thuringiensis serovar pakistani str. T13001
MVFSIKPTDSGAGQIQVFNPTPAVGPAAVTWTSITTGNPVARGDAISLYITPGITASAVYSIFLITDI

SEQ ID NO: 29704 - protein, 50 aa, Bacillus thuringiensis serovar pakistani str. T13001
MEKLIKEPQVKTERELPKTGAASPWMMSVGAGISFLVGGVLFVLGRRRKQ

SEQ ID NO: 29705 - protein, 431 aa, Bacillus thuringiensis serovar pakistani str. T13001; identical to SEQ ID NO: 26472

SEQ ID NO: 29706 - protein, 969 aa, Bacillus thuringiensis serovar pakistani str. T13001
MEYIIGGNIMNKNLKFTQMMIGISTVALSFGSIQTQVSAEEKVPYNILQIKPIGTETSKDEIVHATKTDETLTFEERLKVGDFSQRPTLVMKRDEIQLKQSYSLAELNKMPDSELIDTLSKISWNQITDLFQFNQDTKAFYQNKERMNVIINELGQRGKTFTKENSKGIETFVEVLRSAFYVGYYNNELSYLKERSFHDKCLPALKAIARNPNFALGTAEQDRVIAAYGKLISNASSDTETVQYAVNILKQYNDNLSTYVSNYAKGQAVYEIVKGIDYDIQSYLQDTNKKPNETMWYGKIDNFINEVSRIALVGNITNENSWLINNGIYYAGRLGKFDSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTVKQTLFSKYGSWDFYKYSFALQSYLYNHQFETFDKLQDLIRANDVKKYDSYRESLSNNTQLNAEYQAYMQQLIDNQDKYNIPQVTNDYLIQHAPKPLAEVKNEIVDVANIKDAQITKYESQFFNTFIVEGKYTGGTSKGESEDWKTMSKKVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQIGESLEEEKVLPFNKLVKGNLITPDQTDVYTFNVTDPKEVEISVVNEQNIGMTWILYHESDMQNYVACGEDEGNTIKGKFVAKPGKYYLNVYKFDDKNGEYSLLVK

SEQ ID NO: 29707 - protein, 267 aa, Bacillus thuringiensis serovar pakistani str. T13001
MMALLSIPIHTSAETVTSNQQCHSTNPLDFHSTCKSEATAWGNELFNLWNKLTPQVEKDAIRGYTATDYISINGYLRSDYYDVLDQAKIEKSIKQIDRAFSKVRLHDDIIVYRRVSEQAFGLPGNSLVNHAEQEENPVNSVSKINRENFEFFKNRFQGKYKKDPAYISTSIVKDAAEGFSGAPILMKIHVPKGVPAIYVDPLSNVPGEMELLFPRNRSYKITNISPVIEKDREYIMMDVEILDISSNYLNKRATNIVYDDSLPSLSK

SEQ ID NO: 29708 - protein, 348 aa, Bacillus thuringiensis serovar pakistani str. T13001; identical to SEQ ID NO: 28304

SEQ ID NO: 29709 - protein, 713 aa, Bacillus thuringiensis serovar pakistani str. T13001
MEVLRSGFYLGYYYKELAYLNERTFHDTCLPALQAIANNPAFRLGTIEQDRVVKAYGNLIGNASSNPEIVSLAVPILNQFNQNLQTYAKEYSKGTAVYSLLSGIDYDLQMYLYQTGTSPNQSPWYGKINTFIDEIGKMALYGQVNADTGWIINNGIYYTSRIGDFHTTAQKGLQMITNALQVYPYLSEAYLTAAQQIDERYNGKDYKGNLISYKQIQEAGKKKYIPKAYTFDNGSMIIRTGQQVTTEKAQRLYWASKEVQAQFYRVVGSDTPLEQGHRDDILTMVIYNNPEEYRLNRLLYGYDTNNGGMYIEQDGTFFTYERTPQDSIYSLEELFRHEYTHYLQGRYLVPGLFGEGKLYENERLTWFEEGGAEFFAGSTRTHQVVPRKTIVQQLAVNPLNRYTLQQTLYATYGNWEFYNYAFALQSYLYQNQWDLFSQLHHIIKNNQVIQYDQYRTTVSKDVTLNVAYQNYMQLLIDHQNEYTDSAVSDEYLQQPTAKPLADVQKEITKIIPLQNANMTEQTSDFFHTFTLQGTYTGMKTAGAESDWRNLNTVLDTILEQLSAKPWNGYKTMTAYFTNYRVNTNNQIECEIVFQGIANNIVESKEPNESIQEATPLPFRTNFIGHFDANNSLDMYQLNVQSPNKLAIEVINQHQIQMNWVLYHEKNLKNPVAYAKFQGQQLFETYTAQPGKYYLYVYSYDNRPGRYQGLVTIE

SEQ ID NO: 29710 - protein, 563 aa, Bacillus thuringiensis serovar pakistani str. T13001
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVSGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKPPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNANVVEVAIEDQKVTATVKDFTKLDGKKEFHLQIKSQVKEGVPSGSEIFNTAKIHFTNKNDVIGEKESKPVVVIPTTGIIELTKIDGANKNKLKGVEFVLKDNNGKIVVVAGKEVTGVSDENGIIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 29711 - protein, 397 aa, Bacillus thuringiensis serovar pakistani str. T13001
MAQGGTHNGVNVNGIGEDRMFDIFYYANTDELNMTSNFSELKLACLKVATNKYGANSIEVQAVQNAFDAAKITRTVKENEKTAENQAPELTVPFTITLRVGDTFDPMRNVKAVDKEDGDLTNKVKHKGDVDTSKPGTYIVEYLVVDSQGRNTTARQTVIVEGNGETSDLEPKLTVPVGATIHVGDSFVPMAEVLTIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGIVLTFVRKFRKIQK

SEQ ID NO: 29712 - protein, 53 aa, Bacillus thuringiensis serovar pakistani str. T13001
MKAVEPAPKKVENTLPTTGGKEENPYWKWIGAVMMLLGGFVAIRAYRTQKANK

SEQ ID NO: 29713 - protein, 54 aa, Bacillus thuringiensis serovar pakistani str. T13001
MKAVEPAPKKLEHTLPTTGGKAENPYWMWIGGVVMLLGGLVAIRAYRTNKKANE

SEQ ID NO: 29714 - protein, 998 aa, Bacillus thuringiensis serovar pakistani str. T13001
MALSLGALQTHAVAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYITYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRTNDVKNYDAYRENLSKDPKLNKEYQEYMQQLIDNQDKYNVPEVADDYLAEHAPKSLTEVKKEISDTLPMNDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGNLIGEDHTDVYTFNVASAKDIDISVLNEYGIGMTWVLHHESDMQNYAAYGQANGNHIEAKFNAKPGKYYLSDHGGFSPYNKHFKCKIRSIRPQFAHVNLKRYRIVVQQFLPWISLHVNKHLLSCQSWHVLSVLKHI

SEQ ID NO: 29715 - protein, 333 aa, Bacillus thuringiensis serovar pondicheriensis BGSC 4BA1
MKGKLLKGVLSFGIGLGVLYGASSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 29716 - protein, 72 aa, Bacillus thuringiensis serovar pondicheriensis BGSC 4BA1
MDQEPKGKNQVVENEGRKADTLNKQYTNKPEEGKKSLPSTGGEASTSTLLSGITLVLSALSMFVFRRRLFKK

SEQ ID NO: 29717 - protein, 949 aa, Bacillus thuringiensis serovar pondicheriensis BGSC 4BA1
MALSLGALQAPASAEEKVPYNVLKTKPVGIEKPVDEIGHVSKAEETLSFQERLKVGDFSQRPASITNKATVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGDSEDWNAMSKKVNEALEQLAQKEWSGYKTVTAYFVNYRVNSSNQFEYDVVFHGIAKDDEENKAPTVNINGPYNGLVKEGIQFKSDGSKDEDGKIVSYLWDFGDGSTSAEVNPVHVYESEGSYKVALIVKDDKGKESKSEITVTVKGGSLTESEPNNRPEEANRIGLNNTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 29718 - protein, 55 aa, Bacillus thuringiensis serovar pondicheriensis BGSC 4BA1; identical to SEQ ID NO: 26659

SEQ ID NO: 29719 - protein, 336 aa, Bacillus thuringiensis serovar pondicheriensis BGSC 4BA1
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 29720 - protein, 503 aa, Bacillus thuringiensis serovar pondicheriensis BGSC 4BA1; identical to SEQ ID NO: 26661

SEQ ID NO: 29721 - protein, 412 aa, Bacillus thuringiensis serovar pondicheriensis BGSC 4BA1; identical to SEQ ID NO: 26362

SEQ ID NO: 29722 - protein, 455 aa, Bacillus thuringiensis serovar pondicheriensis BGSC 4BA1; identical to SEQ ID NO: 26452

SEQ ID NO: 29723 - protein, 372 aa, Bacillus thuringiensis serovar pondicheriensis BGSC 4BA1; identical to SEQ ID NO: 28477

SEQ ID NO: 29724 - protein, 74 aa, Bacillus thuringiensis serovar pondicheriensis BGSC 4BA1; identical to SEQ ID NO: 27864

SEQ ID NO: 29725 - protein, 971 aa, Bacillus thuringiensis serovar pondicheriensis BGSC 4BA1; identical to SEQ ID NO: 26666

SEQ ID NO: 29726 - protein, 774 aa, Bacillus thuringiensis serovar pondicheriensis BGSC 4BA1; identical to SEQ ID NO: 26100

SEQ ID NO: 29727 - protein, 212 aa, Bacillus thuringiensis serovar pondicheriensis BGSC 4BA1
MTGSTGPTGSTGVTGNTGTTGSTGNTGPTGATGSTGPTGSTGATGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 29728 - protein, 148 aa, Bacillus thuringiensis serovar pondicheriensis BGSC 4BA1; identical to SEQ ID NO: 26670

SEQ ID NO: 29729 - protein, 50 aa, Bacillus thuringiensis serovar pondicheriensis BGSC 4BA1; identical to SEQ ID NO: 27362

SEQ ID NO: 29730 - protein, 431 aa, Bacillus thuringiensis serovar pondicheriensis BGSC 4BA1; identical to SEQ ID NO: 26106

SEQ ID NO: 29731 - protein, 355 aa, Bacillus thuringiensis serovar pondicheriensis BGSC 4BA1
MDMNGNDVRTDLTTDKDGKISVSDLRPGDYQFIETKAPKHYDLNQNPINFTVEKSQTATASVTATNSLTKGAVELTKVDDIDGTTLEGAIFKIVDSNGHDVRADLTTDKDGKISVSDLRPGDYQFIETKAPTGYDLNAKPIPFTIPKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYY

SEQ ID NO: 29732 - protein, 187 aa, Bacillus thuringiensis serovar pondicheriensis BGSC 4BA1
MEVEKKSKVWEYIGWGSFILVGSFLFFCALILVFGDPKTKYQAQEVTAQGQEVKNAEKDSKKEYSIGETIKLGDHRLTVTEVKKSSGGEYDKPKQGHEYVLVAVNIYNGGKEDISYNPFDFEMRNSQGNITRAVPSIINQNTQLSAGQLAPNGQVAGTVVFEQPIGEKLKLQFTPNFWSKKKIIVNL

SEQ ID NO: 29733 - protein, 178 aa, Bacillus thuringiensis serovar pondicheriensis BGSC 4BA1
MLAMILIPTKDKEEKPKAKETTQQASTEVKEEPKKEEVKKEEPKKELSKEGESSKVKIAVGSVESVDSVGGEYLNEKAQGVFKVVEISITNNQKDAITVDANSFKLMDNQDREFKYSTQAQTAYDIGNGGKSDFFLKQLNPGLTQTGKIIFDIPADAQGLVLKARGGMMGKEIKLKVE

SEQ ID NO: 29734 - protein, 1077 aa, Bacillus thuringiensis serovar pondicheriensis BGSC 4BA1
MFLPRASAEVMTHEKYSMDWSYSNSLGKYIRTEIIKNSSGQIAYCLTLGLKSPNGEDLPEMGKTDNVVYRVLLNGFPQKSVQQLGVANQNEAHYATQLAVWNALGQLDVNELKHENKNVEKAAKAIINAANKSEDTQDIFMNVIPAEKQKAELKGEFFETNLYTVQTNAKSGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGESGEILAGAVFEVFNANNESVGKITTGADGTAELNNLPIGTYTVKEIKAPTGYVLGDKPQTIEVKTGETGAVQIVNNKARGNIEIKKLSDSGKVLPNVEFTVFTEDGKEVKKAVTNENGIAKIEGLTFGKYYFLETKTPNGYIGNKTKYPFEIKEHNKTLTFTVENTEVKGSVKLLKVDTEDISKKLEGAVFELKDASGKVIGEYKTDKNGEINVKDLAYGKYSFVEKTSPNGYVLVKEQIVFEIKEHGKIIELLAVNHLIKGDLEITKVDVADGNNKLPNAQFTIYNEAGKEVVKGKTDDKGIAKFEKLPFGKYTYKETIAPNGYILNEETFSFEITENSQIIKHIVKDEKIPSIKTTASDKKDGTKEMHTSKSVTIQDKVEYKDLQVGKEYTLKGKLMDKKTNKPLVVNGKEVTAEMKFTPKEANGSITLEFTFDATGLEEKEVVVFEELLKDGKVVTTHTDINDKGQTVKFVKPSVKTTATNKADGGKEIHSNDSITIQDKVEYTNLVVGKEYTVKGKLMNKAINEPLLIDGKEVTAETKFIAKEKNGFVTLDFTFVGAEQQGREVVVFEDLLHEGQVIATHADINDVGQTVRFVEPSIKTTATNKADDSKELDASKSVTIQDKVEYKDLIVGKEYVVKGKLMDKATKKPLLVDGKEVTVESKFTAKEKNGSITLDFTFNASALQGKEVVVFEELYQDNVLVAIHVDIEDKGQTVKFKEVKPEQPKPEQPNPVQPHQDKNTPISEQPKEHVKEQPQPKKEVQSKIGWLPQTGADLTSWISMAAGALLLIVGGVIFLKRKNA

SEQ ID NO: 29735 - protein, 965 aa, Bacillus thuringiensis serovar pulsiensis BGSC 4CC1
MNKKSKINKVMLSISTMALSLGALQAPASAEEKVPYNVLKTKPVGIEKPVDEIGHVSKAEETLSFQERLKVGDFSQRPASITNKATVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWGGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVATTKNIDISVLNEYGIGMTWVLHHESDMQNYAAYGQANGNHIEANFNAKPGKYYLYVYKYDNGDGTYELSVK

SEQ ID NO: 29736 - protein, 338 aa, Bacillus thuringiensis serovar pulsiensis BGSC 4CC1; identical to SEQ ID NO: 26105

SEQ ID NO: 29737 - protein, 336 aa, Bacillus thuringiensis serovar pulsiensis BGSC 4CC1
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 29738 - protein, 503 aa, Bacillus thuringiensis serovar pulsiensis BGSC 4CC1
MFNKKMVAMAMTVPLVMGTLSTVSAVETKKQVKVEAYSPQKKAIEYLKGNTNQYGLKPDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 29739 - protein, 412 aa, Bacillus thuringiensis serovar pulsiensis BGSC 4CC1
MKKAKGVVKSVAVASVIMSGSIGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMSSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVLKDTVPALTGYGFSPNVVAVITADKTESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 29740 - protein, 455 aa, Bacillus thuringiensis serovar pulsiensis BGSC 4CC1
MNNRLLKQLQNMKMNKKSLGAVALTAGIIGTTLIPQNAYAHGFVEKPGSRSALCSPTYGALNTNCGSVMYEPQSLEAPKGFPQGGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVPGTHFIDKKLQPSTKYSYTVKAIDAAGNVSKESATLTVKTTVEVPDTEAPTQPKGLHSMGTTASSVDLMWSPSDDNIGVDHYDIYRETKGLMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 29741 - protein, 372 aa, Bacillus thuringiensis serovar pulsiensis BGSC 4CC1
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 29742 - protein, 969 aa, Bacillus thuringiensis serovar pulsiensis BGSC 4CC1
MEYINGGNVMNKNLKFTQMIIGISTMALSFGSIQTHVSAEETAPYNILQMKPIGTETSKDEIVHATKADETLTFEERLKVGDFSQRPTLVMERDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHEKCLPALKAIAKNPNFTLGTAEQDRVVAAYGKLIGNASSDTETVQYAVNVLKQYNDNLTTYVSDYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQIKTNYGGKDYSGNAVNLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTKLNAEYQAYMQQLIDNQDKYNVPQVTNDYLIQHAPKPLVEVKKEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIINMNGPYSGIVNEEIQFHSDGTKSENGKVTSYLWNFGDGTTSTEANPTHVYGEKGTYTVELTVKDSRGKESKDQTKVTVKQDPQTGESHEEEKVLPFNTLVKGNLITPDQTDVYTFNVTNPKEVDISVVNEQNIGMTWVLYHESDMQNYVACGEDEGNTIKGKFEAKRGKYYLNVYKFDDKNGEYSLLVK

SEQ ID NO: 29743 - protein, 74 aa, Bacillus thuringiensis serovar pulsiensis BGSC 4CC1
MIQAISSSILNLTINDSIQFAIESRVGGGPGVRATSARTDLLSLNQGDVLRVRIREATGDIIYSNASLVVSKVD

SEQ ID NO: 29744 - protein, 971 aa, Bacillus thuringiensis serovar pulsiensis BGSC 4CC1
MKGYSKKVLVGVSFASLMLGSFQGGALAEGTKGEQASYRNVLKMEPVGVQLPVQELAHSSKVLENKSFEKRLQFADLSQRPPELKKESKQLAVAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKENADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 29745 - protein, 774 aa, Bacillus thuringiensis serovar pulsiensis BGSC 4CC1
MLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTDEGNNGENPTTPPTGEGNNGGNPTTPSTDEGNNAGSGQTTTDNQNSKETTTVSENKEERDLPKTGTSVASTIGAGLAFIGAGFLLLFRRKKANR

SEQ ID NO: 29746 - protein, 404 aa, Bacillus thuringiensis serovar pulsiensis BGSC 4CC1
MTGSTGPTGNTGVTGSTGATGNTGATGSTGPTGETGATGNTGATGNTGATGSTGPTGNTGATGNTGPTGETGATGSTGNTGPTGETGPTGSTGVTGPTGSTGVTGNTGPTGETGATGSTGNTGPTGETGPTGSTGVTGNTGATGVTGSTGVTGNTGPTGNTGATGATGSTGPTGSTGVTGSTGATGSTGVTGNTGATGSTGNTGPTGETGATGSTGNTGPTGATGSTGPTGSTGTTGVTGSTGPTGSAGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 29747 - protein, 148 aa, Bacillus thuringiensis serovar pulsiensis BGSC 4CC1; identical to SEQ ID NO: 26670

SEQ ID NO: 29748 - protein, 50 aa, Bacillus thuringiensis serovar pulsiensis BGSC 4CC1
MEKLIKEPQVKVERELPKTGAASPWMMSVGAGISFLVGGVLFVLGRRRKQ

SEQ ID NO: 29749 - protein, 431 aa, Bacillus thuringiensis serovar pulsiensis BGSC 4CC1; identical to SEQ ID NO: 26106

SEQ ID NO: 29750 - protein, 201 aa, Bacillus thuringiensis serovar pulsiensis BGSC 4CC1
MTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYY

SEQ ID NO: 29751 - protein, 456 aa, Bacillus thuringiensis serovar pulsiensis BGSC 4CC1
MNKKILGQFRKMATNKKGLSAAAVAVGIMSTTLIPQNAYAHGFVEKPGSRAALCSQNYGALNLNCGNIMYEPQSLEAPKGFPQGGPADGKIASAGGLFGGILDQQTADRWFKNTIKGGENTFTWKYTAPHSTSQWHYYITKKGWDPNKPLTRADFEPIGTVKHDGSKASNNLSHKINVPTDRSGYHVILAVWDVADTVNAFYNVIDVNLINDEKPDKEAPTQPSELQVIKATSNSVEFNWKPATDNEGVKEYQVLRNGELINTVVGTSVIDKKLNPNTEYTYTVRAVDAAGNISEESEALVIKTTEEKPDTEAPTQPKGLHSMGTTTSSIDLMWSPSEDNIDVSHYIVYREVGGVMKEIGTANTTSFMDKDLQTNTAYKYVVSAVDTSGNESMKSDAITVTTKGQENSYEQWDARKAYKVGDRVVHEDKVYEAVQSYQGNGDPNWIFALSLWKEVN

SEQ ID NO: 29752 - protein, 769 aa, Bacillus thuringiensis serovar pulsiensis BGSC 4CC1
MGSFSLNAVAETEESAKMISNWKRVLVGEPFTNNDAILKNIVLDKEKDLQDNVLSNLNKENESPSLFKNLPDWKQNSAQITETVKNIEKMAVLYQTPNSIYYQKDTLQKDIMYAMEYFYDQMYNEKIKNTYGNWWDWEIGTPQSYNNILVLMFDDLTEVELSKYIMAVDRFVPDPTKRLNGIKETGANLLDKSFIVMVRGILNNNSNKIQLGIDATNDVYKIVQNGDGFYKDGSFIQHTYNPYTGGYGEVLLARSADIHELFSGTDRLTNVQGIKKLYTYIETTYLPVMKQGEVFDMTRGRGMSRQNSSSSIVGRNILYEILVISSQNQDLSYRGKYARYVKEAIFQHNNSESYYNGLSIHKTQTFQRLMSDSSIKPDFGVRDTNNMLSAMNQMTHQKKDFAAGLSLFGKQISSFEYGNGENMKGFYMGTGMLYFYNNDLGQYDNDYWATIDMTRLPGTTTDHKLGNLIDWKNYNNPKSWSGGVSDGQIGSASMYYTMQNVTGSSLEAKKSWFFLKDKIVAMAAGINSKENADTETIVENRRLEKDGSNLLEVENTEVALDQGILFKGASWAHLKGKNNESDIGYVFPQSENIYAEKKERSGKWSDINKGGSSDQVSNMFATLSIPHGKSPSGGEYVYVILPGKNQEETSTFAKEMDVSILSNTPTQQVIYDDADDIWMGNFYEIGKVNEVEAKTRGAIVINYKDNGVKVVMADPMKEQVKVIFTIPKKIGYKVAEKDDEITVKEDANSWIIEMDSSDKSGKSSQVYFE

SEQ ID NO: 29753 - protein, 369 aa, Bacillus thuringiensis serovar pulsiensis BGSC 4CC1
MKQLKPAISVLGSVSMALTLASPALADEKQQNPGRTVEIFKENANVKKEDKNFTLGSDGEIGSLITQNIEMANNDWDKDGISNDLEINGYKIEFNSQTGKNEAKAWDPEKDKGKPKFISNPINANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGASG

SEQ ID NO: 29754 - protein, 174 aa, Bacillus thuringiensis serovar pulsiensis BGSC 4CC1; identical to SEQ ID NO: 29660

SEQ ID NO: 29755 - protein, 457 aa, Bacillus thuringiensis serovar pulsiensis BGSC 4CC1; identical to SEQ ID NO: 29602

SEQ ID NO: 29756 - protein, 163 aa, Bacillus thuringiensis serovar sotto str. T04001; identical to SEQ ID NO: 29348

SEQ ID NO: 29757 - protein, 949 aa, Bacillus thuringiensis serovar sotto str. T04001
MALSLGALQTHAVAEEKVPYNVLKTKPVGIEKPVDEVGHVSKVDETLSFQERLKVGDFSQRPASITKKTAVKQVKESYSMADLNKMNDQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 29758 - protein, 111 aa, Bacillus thuringiensis serovar sotto str. T04001
MYKKLGTIALTGALAFSLAACGETEVKEVSKNDAPKQAEKKDKKEKAESKIYKIGDTVEVNGLQLTFSSAKFVEPNEYVKAEKGKVLEIAFNAKNNGKKDIYFGTSELKNC

SEQ ID NO: 29759 - protein, 333 aa, Bacillus thuringiensis serovar sotto str. T04001; identical to SEQ ID NO: 29357

SEQ ID NO: 29760 - protein, 185 aa, Bacillus thuringiensis serovar sotto str. T04001
MNFLIHLPFKAEAATKELKGLGDVSYYNAIIFGDHSATSADIEGAMAVQKNMNASSYTVVAAATGANNLAGATWVDEGYPSLLLGGQFTKAGAGQVIIQDGTVAMTKDGDPDGAMKTSYDRISYKEQAEIDAKFKEFRKDVDGVIGDASKLQTDKSKSNMSFGIGEDVNNPNIYVSSGQTGKENI

SEQ ID NO: 29761 - protein, 195 aa, Bacillus thuringiensis serovar sotto str. T04001
MNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 29762 - protein, 476 aa, Bacillus thuringiensis serovar sotto str. T04001
MKKFTNDGKIVKEDVKPVMGATPTQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVIVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 29763 - protein, 377 aa, Bacillus thuringiensis serovar sotto str. T04001
MHMKEKRYKNMKTKKTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 29764 - protein, 783 aa, Bacillus thuringiensis serovar sotto str. T04001
MLVKNQDKCSKFQAPIPFPPPGITGPTGPTGPTGALGGPTGPQGIQGVQGPIGPTGPTGIQGVQGVQGENGPTGPTGLTGPQGSQGSQGPMGEQGPQGIQGVQGIQGERGPTGPTGIQGIQGIPGPIGPTGSTGIQGIQGMQGEVGPTGPTGIQGIQGVQGDNGPTGPTGNTGIQGVQGNLGSSGLQGITGIQGIQGLIGPTGPTGSQGIQGEQGPMGPQGETGVQGLQGPQGEMGQVGPTGSQGIQGVQGVIGPTGATGLQGDPGPTGSTGSTGITGPTGSATGPTGATGPTGPPGGPTGPTGPAGSPGGPTGPTGATGATGATGATGATGIQGVQGIQGPTGATGLTGLQGVQGPMGATGPTGDQGIQGPQGIQGVTGPTGPQGLQGLQGSIGPTGPTGPQGVQGAQGPIGPTGPQGVQGIQGEQGVRGATGPTGLQGLQGVQGPSGPTGPQGVQGVQGPSGITGPTGPQGIQGIQGPQGSIGPTGPQGIQGVQGPQGPTGPTGATGPQGIQGIQGPIGPTGPQGIQGIQGVQGPIGPTGPTGPQGLQGITGQAGPTGPTGATGPTGETGPQGPQGIQGSQGEMGPTGATGQTGVTGATGPTGIQGIQGITGATGGTGVTGPTGATGPTGLTGATGSSAISTGGGYFFSTSTSTIAASANIPINSGSTVYGTGVSLTSATTVTVSTPGIYLVSYYFQGDATGGNEVVSVRLLLNGTQVTGSFIQNVTTSTVVLEPSISNTLLVNVASANSTFILQNGPLGVGHVTTIAGTITASLNVVRIL

SEQ ID NO: 29765 - protein, 797 aa, Bacillus thuringiensis serovar sotto str. T04001
MALPLPLIGATGPTGNSGPVGPTGGHEGPVGPTGMTGPTGATGPQGPQGIRGIQGSRGTTGAQGIQGAVGDTGEQGITGPTGLQGAQGLIGNQGPIGDIGVQGLEGTQGATGPAGSQGIQGIQGIQGEVGERGQTGAQGIQGERGGTGVPGVTGSQGPQGVQGIQGEQGATGIQGEDGAQGIQGITGEQGHQGDQGAQGVVGTTGSTGIQGPQGISGIKGITGVTGPQGPQGVQGIQGVSGSTGFQGAKGVRGITGATGPTGTQGSEGPPGGPTGTTGPIGPSSGVTGPSGPPGPPGGPTGPTGATGSTGVSGGIGPIGAQGVQGITGPTGPQGVRGAQGSQGVVGAVGVQGAQGPQGNPGITGPTGAEGSQGIQGTRGVTGPTGAEGPKGIQGVIGPTGAQGMVGIQGIAGPAGVTGAEGVQGEQGIRGATGPAGAQGIQGVQGIQGETGAAGAQGPQGVQGIQGTTGLTGAQGLQGVQGIIGPTGAIGLQGPQGLQGITGPTGVQGVQGIQGVQGIIGPTGAQGIRGPQGNTGEVGITGPQGVQGAQGSQGPQGPQGNIGITGATGETGATGATGSTGPQGVQGVQGITGIQGITGMTGDIGATGPQGIQGIQGIQGLQGPIGASGVTGASGSIGPVGAQGSQGQNGATGATGLPSGGGYFFSTATSTIAANALIPINSGSTIFGAGVSLTNATTITLSTPGIYLISYYFQGDAILGNETISVRLVLNGTQVAGSFILYVTKGNFILEPAISNTMVIEVTSPNSTLSLQNGPLAIGHVTTLAGIITASLNILQIV

SEQ ID NO: 29766 - protein, 181 aa, Bacillus thuringiensis serovar sotto str. T04001; identical to SEQ ID NO: 29443

SEQ ID NO: 29767 - protein, 39 aa, Bacillus thuringiensis serovar sotto str. T04001; identical to SEQ ID NO: 29444

SEQ ID NO: 29768 - protein, 450 aa, Bacillus thuringiensis serovar sotto str. T04001
MERLRTSKKGIGACVLAAGMTAITMAPQSAYAHGFVEKPSSRAALCSQNYGVLNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHTIPDMEAPTQPKGLHSMGTTSTTVDLMWSPSEDNVGVDHYIVYRESAGVMNKIGTAANTSFMDKDLKANTSYNYVVTAVDLAGNESSRSDVLNVTTKSENSAYEKWDARKAYTKGDRVVHEGKVYEAVQNHQGNGDSNWIFALSLWKPVLNK

SEQ ID NO: 29769 - protein, 311 aa, Bacillus thuringiensis serovar sotto str. T04001
MIALKRSNVKEVINMSSWSNNINGYCGCNNQNGVHVDSCCFSCDGTVPKVGPTGPTGATGITGATGSTGATGVTGDTGATGATGVTGATGVTGDTGPTGATGITGATGATGPTGVTGITGATGPTGATGGTGPTGATGVTGATGVTGDTGATGATGVTGDTGATGATGPTGATGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 29770 - protein, 951 aa, Bacillus thuringiensis serovar sotto str. T04001
MKNRDNKGKQQSNFRIPPELIGPTFPPVPTGFTGIGITGPTGPQGSTGPQGPRGFQGPMGEMGPTGPQGVQGIQGPVGPIGATGPEGQQGAQGLRGPQGETGATGPQGVQGLQGPIGPTGATGAQGIQGIQGLQGPIGATGPEGPQGIQGVQGLPGATGPQGIQGAQGIQGTQGPSGNTGATGATGQGLTGPTGITGPTGITGPSGGPPGPTGPTGATGPGGGPSGSTGATGATGDTGATGSTGVTGETGTTGPTGSTGAQGLQGIQGIQGPIGPTGPEGPQGIQGIPGPTGITGEQGIQGVQGIQGVTGATGDQGPQGIQGTIGPQGATGATGDQGPQGIQGVPGPSGATGPQGVQGIQGPMGDIGPTGPEGPEGLQGPQGIQGVPGPAGATGPEGPQGIQGIQGPVGATGPEGPQGIQGIQGVQGITGATGVQGATGIQGIQGEIGATGPEGPQGVQGAQGAIGPTGPMGPQGVQGIQGIQGATGAQGVQGPQGIQGIQGPTGATGDTGATGATGEGTTGPTGITGATGVTGPYGGPAGPSGPTGPSGPTGVTGPSGGPPGPTGATGATGVTGDTGATGSTGVTGATGETGATGVTGLQGPQGIQGVQGDIGPTGPQGIQGPQGIQGVTGATGDQGPQGIQGPQGIQGPTGPQGIQGEQGPQGIQGATGATGAQGPQGIQGIQGIQGPTGPQGPTGIQGVQGEIGPTGPQGVQGLQGPQGPTGDTGATGAQGPQGVQGIQGPTGATGATGATGPQGIQGPQGIQGPTGATGATGSQGPTGNTGPTGSQGIQGPTGPTGAGATGATGATGATGVSTTATYAFANNTSGSIISVLLGGTNIPLPNNQNIGPGITVSGGNTVFTVANAGNYYIAYTINLTAGLLVSSRITVNGSPLAGTINSPAVAAGSFSATIIANLPAGAAVSLQLFGVIALATLSTATPGATLTIIRLS

SEQ ID NO: 29771 - protein, 323 aa, Bacillus thuringiensis serovar sotto str. T04001
MKSRHKIRSATQKYRIRNIHIVVLFLKLDFQNIERRTYMYQRNCFSCDGRRNSGGSNGNTGPTGSTGATGSTGPSGPTGATGPTGSAGPSGAGFQSTTTFSLAAAPNYKKGQVVTYTGSGYVVKKDAPQGFPNVSPDYIILVESGPTGSTGPTGNTGPMGSAGSASAKSIVFQGTNAGFQRIAGSPGIDSNVIPYVTAGAGSIVGFSASININNLPAAVYTINICRNVPTNLTSPTSSYILSTITLTTTDKITGTMVFSIKPTDSGAGQIQVFNPTPAVGPATVTWTSITTGNPIVRGDAISLYITPGITASAVYSVFLITDI

SEQ ID NO: 29772 - protein, 431 aa, Bacillus thuringiensis serovar sotto str. T04001; identical to SEQ ID NO: 26534

SEQ ID NO: 29773 - protein, 183 aa, Bacillus thuringiensis serovar sotto str. T04001; identical to SEQ ID NO: 29356

SEQ ID NO: 29774 - protein, 964 aa, Bacillus thuringiensis serovar sotto str. T04001
MLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEDAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGETGNYTVEVK

SEQ ID NO: 29775 - protein, 188 aa, Bacillus thuringiensis serovar sotto str. T04001; identical to SEQ ID NO: 29384

SEQ ID NO: 29776 - protein, 131 aa, Bacillus thuringiensis serovar sotto str. T04001
MKKAKEIAKCVAVASVIMSGSFSLQATSAFADSKGTVENLQNGGKVYNSFKTTYDMKQNIKNSIKVSFIEDPYADKKIAIVTTDGSNIDAKYTVNSGYYNAGLKWPSAYHTEAEITSGDSAQFHKATQLIQ

SEQ ID NO: 29777 - protein, 295 aa, Bacillus thuringiensis serovar sotto str. T04001
MEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 29778 - protein, 356 aa, Bacillus thuringiensis serovar sotto str. T04001
MEKKKGNRKEKLNDSPLAPDTIGPTLPPIPSITFPTGFTGPTGPKGATGPQGIQGEPGAIGPTGPQGVQGIQGEPGPEGATGPQGVQGIQGEPGAIGPTGPQGVQGIQGIQGSKGATGPIGNTGPTGIGITGPTGPTGSGGGGITGPTGPTGPGEGPTGPVGPQGPTGPQGVQGIQGEPGPEGPTGFQGVQGIQGEPGPEGPTGPQGVQGIQGEPGAVGPILQPFVNSSIFSQTIAVNGLLNIRGVITTSGVDFNGVDTLTIITPGLYYLDVVLNLSTETPANSQFQVFLNGITVAPIGNANTGGPMSLSRVAMYSTGNTVSIRNGSRHPVTIVDGVSLSSAGRFSFFRFADGPQT

SEQ ID NO: 29779 - protein, 163 aa, Bacillus thuringiensis serovar thuringiensis str. T01001; identical to SEQ ID NO: 29310

SEQ ID NO: 29780 - protein, 949 aa, Bacillus thuringiensis serovar thuringiensis str. T01001; identical to SEQ ID NO: 29311

SEQ ID NO: 29781 - protein, 176 aa, Bacillus thuringiensis serovar thuringiensis str. T01001; identical to SEQ ID NO: 29312

SEQ ID NO: 29782 - protein, 348 aa, Bacillus thuringiensis serovar thuringiensis str. T01001; identical to SEQ ID NO: 28304

SEQ ID NO: 29783 - protein, 172 aa, Bacillus thuringiensis serovar thuringiensis str. T01001; identical to SEQ ID NO: 28096

SEQ ID NO: 29784 - protein, 336 aa, Bacillus thuringiensis serovar thuringiensis str. T01001; identical to SEQ ID NO: 27901

SEQ ID NO: 29785 - protein, 503 aa, Bacillus thuringiensis serovar thuringiensis str. T01001; identical to SEQ ID NO: 26634

SEQ ID NO: 29786 - protein, 329 aa, Bacillus thuringiensis serovar thuringiensis str. T01001
MFINFSLLDINRIILPHSPTGPTGATGSTGPTGATGSTGATGPTGSTGTTGSTGPTGSTGPTGATGTTGATGSTGSTGTTGTTGATGSTGSTGSTGTTGTTGTTGATGSTGSTGSTGSTGTTGATGLTGSTGPTGATGATGATGLTGSTGPTGTTGSTGPTGTTGSTGSTGTTGTTGATGSTGPTGAASVGLTNYLYVFDTTNQSIAVGSNVTFNTNGPITGTALSHITGTGNIIINTLGTYLAEFQLQASRENQFSLELNGTPISGGRFGAGSPHTINQGTAAFTVTVVPSTLTLINNTSSAGTITLSNSDGGSLTNVSASISIFQVG

SEQ ID NO: 29787 - protein, 893 aa, Bacillus thuringiensis serovar thuringiensis str. T01001; identical to SEQ ID NO: 29345

SEQ ID NO: 29788 - protein, 563 aa, Bacillus thuringiensis serovar thuringiensis str. T01001; identical to SEQ ID NO: 29318

SEQ ID NO: 29789 - protein, 88 aa, Bacillus thuringiensis serovar thuringiensis str. T01001
MDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 29790 - protein, 878 aa, Bacillus thuringiensis serovar thuringiensis str. T01001; identical to SEQ ID NO: 29319

SEQ ID NO: 29791 - protein, 378 aa, Bacillus thuringiensis serovar thuringiensis str. T01001; identical to SEQ ID NO: 29320

SEQ ID NO: 29792 - protein, 614 aa, Bacillus thuringiensis serovar thuringiensis str. T01001; identical to SEQ ID NO: 29321

SEQ ID NO: 29793 - protein, 223 aa, Bacillus thuringiensis serovar thuringiensis str. T01001; identical to SEQ ID NO: 29346

SEQ ID NO: 29794 - protein, 298 aa, Bacillus thuringiensis serovar thuringiensis str. T01001
MKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDKEAPTQPKGLHSMGTTATTVDLMWSPSEDNVDVDHYIVYRESAGVMNKIGTSANTSFIDKGLKANTSYKYVVTAVDLAGNESSRSDVLNITTKLEDSTYEKWDARKVYTKGDRVVHEGKVYEAVQDHQGNGDSNWIFALSLWKPVLNK

SEQ ID NO: 29795 - protein, 746 aa, Bacillus thuringiensis serovar thuringiensis str. T01001; identical to SEQ ID NO: 29325

SEQ ID NO: 29796 - protein, 412 aa, Bacillus thuringiensis serovar thuringiensis str. T01001; identical to SEQ ID NO: 29326

SEQ ID NO: 29797 - protein, 1062 aa, Bacillus thuringiensis serovar thuringiensis str. T01001; identical to SEQ ID NO: 29327

SEQ ID NO: 29798 - protein, 971 aa, Bacillus thuringiensis serovar thuringiensis str. T01001; identical to SEQ ID NO: 29328

SEQ ID NO: 29799 - protein, 368 aa, Bacillus thuringiensis serovar thuringiensis str. T01001; identical to SEQ ID NO: 29329

SEQ ID NO: 29800 - protein, 431 aa, Bacillus thuringiensis serovar thuringiensis str. T01001; identical to SEQ ID NO: 26534

SEQ ID NO: 29801 - protein, 787 aa, Bacillus thuringiensis serovar thuringiensis str. T01001
MTYMKKKLVSVVTCTLLAPIFLTGNVNSVNADSKKSQPSTAQENQEKPVDRKGLLGYFFKGQEFNHLTLFAPTRDNTLIYDQQTANSLLDTKQQEYQSIRWIGLIQSKETGDFTFNLSDDQHAIIEIDGKIISHKGQNKQVVHLEKGKLVPIKIEYQSDQLLNRDSNIFKEFKLFKVDSQQHAHQVQLDELRNPAFNKKETQQFLEKASKTNLFTQDIKRDTDDDDKDTDGDSIPDLWEENGYTIQNKIAVKWDDSFAAKGYTKFVSNPLDSHTVGDPYTDYEKAARDLDLANAKETFNPLVAAFPSVNVNLEKVILSKDENLSNSVESHSSTNWSYTNTEGASIEAGAKPEGPTFGVSATYQHSETVAKEWGTSTGNTSQFNTASAGYLNANVRYNNVGTGAIYEVKPTTSFVLDNNTFATITAKSNSTALSISPGESYPKKGQNGIAINTMDDFNSHPIKLNKQQLDQVLNNDPIMLETNQADGVYKIKDTSGNIVTGGEWNGVIQQIQAKTASIIVDTGESVSEKRIAAKNYDNPEDKTPSLSLKEALKLGYPEEIKEKDGLLYYNDKPIYESSVMTYLDENTAKEVKEQLNDTTGKFKDVKQLFDVKLTPKMNFTIKLATLYDGAEDGSSPTDKGISSPLGEWVFKPDINNVEGGNTGKRQYRLSKSQDDNIYYGMLAFTSEVSNKLKKNYQYYISMSIKADIGVEPTVSIIGASDRIVNKQFKLNSNGYQRFDILVDNSESNPIDAILLDLGVSNQAPINYSKDIYIDDITITEVSAMKEKN

SEQ ID NO: 29802 - protein, 61 aa, Bacillus thuringiensis serovar thuringiensis str. T01001; identical to SEQ ID NO: 29541

SEQ ID NO: 29803 - protein, 183 aa, Bacillus thuringiensis serovar thuringiensis str. T01001; identical to SEQ ID NO: 26916

SEQ ID NO: 29804 - protein, 878 aa, Bacillus thuringiensis serovar thuringiensis str. T01001
MTYMKKKLVSVVTCTLLAPIFLTGNVHPVNADSKKSQPSTAQEKQEKPVDRKGLLGYFFKGKEFNHLTLFAPTRDNTLIYDQQTANSLLDTKQQEYQSIRWIGLIQSKETGDFTFNLSDDQNAIIEIDGKIISHKGQNKQVVHLEKGKLVPIKIEYQSDQILTRDSNIFKEFQLFKVDSQQHSHQVQLDELRNPDFNKKETQQFLEKAAKTNLFTQNMKRDTDDDDDTDTDGDSIPDLWEENGYTIQNKVAVKWDDSFAAKGYTKFVSNPLESHTVGDPYTDYEKAARDLDLANAKETFNPLVAAFPSVNVNLEKVILSPDENLSNSVESHSSTNWSYTNTEGASIEAGGGPLGISFGVSANYQHSETVAKEWGTSTGNTSQFNTASAGYLNANVRYNNVGTGAIYEVKPTTSFVLDKDTVATITAKSNSTALSISPGESYPKKGQNGIAINTMDDFNSHPITLNKQQLDQLLNNKPLMLETNQADGVYKIKDTSGNIVTGGEWNGVIQQIQAKTASIIVDTGESVSEKRVAAKDYDNPEDKTPSLSLKEALKLGYPEEIKEKDGLLYYKDKPIYESSVMTYLDENTAKEVEKQLQDTTGIYKDINHLYDVKLTPTMNFTIKLASLYDGAENNDVKNGPIGHWYYTYNTGGGNTGKHQYRSANPSANVVLSSEAKSKLDKNTNYYLSMYMKAESDTEPTIEVSGENSTITSKKVKLNSEGYQRVDILVPNSERNPINQIYVRGNNTTNVYWDDVSITNISAINPKTLTDEEIKEIYKDFSESKDWPWFNDVTFKNIKPLENYVKQYRVDFWNTNSDRSFNRIKDSYPVNEDGSVKVNMTEYNEGYPLRIESAYHLNISAITYDGREIPVYSSSWPSNK

SEQ ID NO: 29805 - protein, 451 aa, Bacillus thuringiensis serovar thuringiensis str. T01001; identical to SEQ ID NO: 29543

SEQ ID NO: 29806 - protein, 949 aa, Bacillus thuringiensis serovar tochigiensis BGSC 4Y1
MALSLGALQTHVVAEEKVPYNVLKTKPVGIEKSVDEIGHVSKAEEKLSFQERLKVGDFSQRPASIPNKAAVKQVKESYSMADLNKMNDQELVETLGSIKWHQITDLFQFNEDAKAFYKDKGKMQVIIDELAHRGSTFTRDDSKGIQTFTEVLRSAFYLAFYNNELSELNERSFQDKCLPALKAIAKNPNFKLGTDEQDTVVSAYGKLISNASSDVETVQYAANILKQYNDNLHTYVDDRMKGQAVYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEISDTLPMKDVKMTKHRSQFFNTFTLEGTYTGSVTKGESEDWNAMSKKVNEALEQLAQKDWSGYKTVTAYFVNYRVNSSNQFEYDVVFHGIAKDDGENKAPTININGPYNGLVKEGIQFKSDGSKDEDGKIVSYLWDFGDGSTSAEVNPVHVYERKGSYKVTLIVKDDKGRESRSETTVTVKDGSLTELEPNNRPEEANRIGLNNTIKGSLFGGDHTDVYTFNVASAKDIDISVLNEYGIGMTWVLHHESDMQNYAAYGQANGNHIEANFNAKPGKYYLYVYKYDNGDGTYELSVK

SEQ ID NO: 29807 - protein, 338 aa, Bacillus thuringiensis serovar tochigiensis BGSC 4Y1
MEVWNVKGKLLKGVLSFGIGLGVLYGGSSAQADTSTNQNNILKVMTHNVYMLSTNLYPNWGQSERADLIGAADYIKNQDVIILNEVFDNSASDRLLGNLKREYPNQTAVLGRSNGNEWDKTLGSYSSSTPEDGGVAIVSKWPIIEKIQYVFAQGCGPDNLSNKGFVYTKIKKNDHFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIISSKDHANPSFIENKVLQPKSPQWTVTSWLKKYTYNDYSDHYPVEATISMK

SEQ ID NO: 29808 - protein, 336 aa, Bacillus thuringiensis serovar tochigiensis BGSC 4Y1; identical to SEQ ID NO: 29719

SEQ ID NO: 29809 - protein, 553 aa, Bacillus thuringiensis serovar tochigiensis BGSC 4Y1
MKRIFSLLLIFVLAFSALMNMTVSAESKSTGTLTIHKFEQSKDFKTTTEGNGKEGQTVPEGAKPLEGVTFEIKRIESFEKISNDGTVIKEETKPVKDDAITKVTNAKGEAVFTNLPLGRYEVKAIKGPEHIELDMTTFIVDIPMTSTNGKELNYDVHIYPKNETKRGSVEFIKKGEGGKVLKDAEFHLFKKNKDGTSTQVKTPSSLVTGEDGKIRVDSLEYGDYYYFIEHKAPTDYLTSKEERPFSIKESGKVVKLDDIKNYKEPTITKSINNGSKVAGINKETDYTYDIKTLLPEDIQSYKKYVVKDILDDRLEIKGLPIVMVDGKKVEDDSVKVVVEGQKVTATIKDFSKINGKELHLQITAKINSDVESGVKIPNKAVLDFVNKDDVSSEKDGKPSNEVVVTPTTGNIKIEKVDGKDKTLKLEGAKFQLQDKKGNVIKVNGKEMNDITDANGIITWNEIPYGEYQIVETEAPKYKDKDGAVEHYQKLRDPINITIDEKHQKIDLQVENNKSGWIIPATGGMGTIFFTVVGLMLMAVATFIFFRKKPVKNS

SEQ ID NO: 29810 - protein, 503 aa, Bacillus thuringiensis serovar tochigiensis BGSC 4Y1
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQSVKGVKEATTKISEKDAIQKSMAYVGEVSEQNLWAPTEKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 29811 - protein, 455 aa, Bacillus thuringiensis serovar tochigiensis BGSC 4Y1
MKNRFLKQLQNMKMNKKSLGAVALTAGIIGTTLIPQNAYAHGFVEKPGSRSALCSPTYGALNVNCGSVMYEPQSLEAPKGFPQGGPVDGQIASAGGKFGGVLDQQTANRWFKNTITVGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNGIQAQKVTAHSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVDHYDIYRETEGSMKKIATSNTTAYIDKNLLPNTTYKYVVKAVDVAGNESVQSDIFTITTKTESASYEEWDATKAYEKGDRVLYEGKVYEAVQSYKGNGDPNWIYALSLWKTV

SEQ ID NO: 29812 - protein, 862 aa, Bacillus thuringiensis serovar tochigiensis BGSC 4Y1
MTITCNGLQIQAETKEKNVKNVLQMEPVGIQKSVDELAHPSKLQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPAVKTIAKNPNFKLGTSEQNKVIASYGKLIGNASADVETVLYAGEIFKQYNDNLATFIEDRTKGDAIYELMKGIDFDIQTDMYTTGKEPKDTMWYRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSAAKGEVKDWKVMNEATNDMLKRLSGKEWTGYKTLTAYFVNYRVNNAGQYEYDVVFSGVNTEEGTAVEKEPNNSFETANPLSLNILLRGTLSDQDQGDKFVIDVKDQKDLQISVTNEQNLGLNWVLYSESDLNNYVAYATIRDGNKLLGNYNAKPGKYYLSVYKYGGGTGNYTVQVK

SEQ ID NO: 29813 - protein, 974 aa, Bacillus thuringiensis serovar tochigiensis BGSC 4Y1
MLYFWMEYINGGNVMNKNLKFTQMMIGISTMALSFGSIQTQVSAEETAPYNILQMKPMGTETSKDEIVHATKADETLNFEERLKIGDFSQRPTLVMKRDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHDKCLPALKAIAKNRNFTLGTAEQDRVVTAYGKLIGNASSDTETVQYAVNILKQYNDNLSTYESDYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQMKTNYGGKDYSGNAVDLQKIREEGKRQYLPKTYTFDDGSIVFKTGDKVTEEKIKKLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSNPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKAMSKQVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKVTVKQDPQTGESYDEEKVLPFNTLVKGNLITPDQTDVYTFNVTDPKEVDISVVNEQNIGMTWVLYHESDMQNYVACGEDEGNVIKGKFAAKPGKYYLNVYKFDDKNGEYSLLIK

SEQ ID NO: 29814 - protein, 382 aa, Bacillus thuringiensis serovar tochigiensis BGSC 4Y1
MHMKEKRYKNMKTKQTIAASTLALAMIAGANSAHAEVTDATPQQSTGDRLAEIKQHKQELDAKLQQHKENVDQTLNELNKVKENVDTKVNELHERKQVADEKINEIKQRKEEFDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQNVSDDLSKKKQDLDIKINDFKHTEKKIDDKLAELHTTKQNVDNKINEVSQSKQTETKTGTTNANNNARELPNAGSEQSNNMALGMLSVLGGVLLIARNKIKTLFSK

SEQ ID NO: 29815 - protein, 91 aa, Bacillus thuringiensis serovar tochigiensis BGSC 4Y1
MDKELKANTSYKYVVTAVDLAGNESSRSDVLDVTTKVEDSTYEKWDARKAYTKGDRVVYEGKVYEAVQGYQGNGDTNWIFALSLWKPVLSK

SEQ ID NO: 29816 - protein, 837 aa, Bacillus thuringiensis serovar tochigiensis BGSC 4Y1
MLVKDQDKCSKFQAPIPFPASGITGPTGPTGPTGSLGGPTGPQGIQGVQGPIGPTGPTGIQGVQGVQGENGPTGPTGLTGPQGSQGNQGPMGERGPQGIQGVQGIQGERGPTGPTGIQGIQGIPGSIGPTGPTGIQGVQGVQGEIGPTGPTGIQGIQGVQGEIGPTGPTGNTGIQGVQGDLGNSGLQGVTGIQGIQGPIGPTGPTGSQGIQGEQGPMGPTGATGVQGLQGPQGEMGLTGPTGSQGIQGVQGVIGPTGPTGLQGDPGPTGSTGPTGVTGPTGSATGPTGATGPTGPPGGPTGPTGPAGSPGGPTGPTGATGATGATGATGATGIQGVQGVQGPTGATGLTGLQGVQGPMGATGPTGDQGIQGPQGVMGVTGPTGLQGLQGIQGPVGATGPTGPQGVQGAQGPIGQAGPQGIQGIQGEQGVRGATGPTGLQGLQGIQGIQGPTGPQGIQGVQGLSGITGPTGPQGIQGIQGPQGNIGPTGSTGIQGVQGPEGPTGPTGATGPQGIQGIQGLQGPTGPQGIQGIQGIQGPIGPTGPTGPQGIQGITGSTGPTGQAGATGQAGVTGPQGPQGIQGPQGVTGQTGATGETGATGSQGPQGIQGPQGITGPTGATGPTGATGPIGPQGIQGPQGVTGATGATGATGVTGATGPTGIQGIQGITGATGGTGVTGPTGATGPTGLTGATGSSAISTGGGYFFSTSTSAIAANANIAINSGSTVYGTGVSLTSPTTVTVSTPGIYLVSYYFQGDATGGNETVSVRLLLNGTQVAGSFIQNVTISTVVIEPAISNTLLVNVTSANSTLVLQNGPLGVGHVTTIAGAITASLNVVRIL

SEQ ID NO: 29817 - protein, 824 aa, Bacillus thuringiensis serovar tochigiensis BGSC 4Y1
MALPLPLIGATGPTGNSGPIGPTGGHEGPVGPTGVTGPTGATGSQGPQGIRGIQGPRGTTGAQGIQGAIGNTGEQGVTGPTGLQGPQGLIGNQGPTGDIGVQGLEGVQGAIGPAGSQGIQGPQGIQGEIGERGQTGAQGMQGVIGEAGITGVTGPQGSQGAQGIQGEDGTTGIQGEEGPQGIQGITGEQGHQGDQGIQGIVGPTGSTGPQGSQGISGIKGITGVIGPQGPSGIQGIQGINGSTGFQGAKGTRGITGVTGPTGTQGPVGPPGGPTGTTGPIGPSSGVTGPSGPPGPPGGPTGPTGETGARGITGGTGAIGAQGLQGITGPTGPQGVRGAQGAQGVVGAVGFQGAQGPQGFQGITGATGVEGPQGIQGPQGAIGPTGAEGPKGVQGIQGVTGPTGAQGMQGLQGIQGPTGVAGAAGAQGAQGIQGATGPTGVQGIQGAQGIRGETGAAGVQGIQGVQGIQGITGLTGPQGAQGPQGVQGIIGPTGAIGLQGVQGIQGIVGPTGAQGSQGMQGIQGITGPTGAQGIRGPQGNLGENGITGPQGVQGAQGIEGPEGPQGNIGATGVTGETGATGEVGATGAQGIQGVQGIMGIQGSTGMTGPTGATGVTGIQGSQGIQGPQGPTGARGATGVSGSVGPAGAQGSQGPIGAVGPIGATGSAGSIGFLGIAGATGATGLPSGGGYFFSTSTSTIAANALIPINSGSTVFGSGVSLTNATTVTLSTPGIYLVSYYFQGDPTAGNETISVRLTLNGTQVAGSFIFYVTGGTFILEPAVSNTMLIEVTSSNATLSLQNGPLAIGHVTTLSGVITASLNVLKIV

SEQ ID NO: 29818 - protein, 412 aa, Bacillus thuringiensis serovar tochigiensis BGSC 4Y1
MKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALVEQMSSINNVNNQLNKGKGKLSFSMNGNQLKATSSNAGYGISYEDKNWGIFVNGEKVYTFNEKTTVGNISNDINKLNIKGPYIEIKQI

SEQ ID NO: 29819 - protein, 971 aa, Bacillus thuringiensis serovar tochigiensis BGSC 4Y1
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQINGLFQFNKDSLAFYQNDSRIQAIIDKLQQQGQAYTKDDSKGIETLVEVLRSGFYLGFYHTELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTAKNGWLINNGIYYTGRLGTFHSTGTKGVQVVTDAMKIYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTTEESIYSLEELFRHEFTHYLQGRYEVPGLWGQGKMYENERLSWFEEGNAEFFAGATRTDNVVPRKSIIGGISSNPADRYTAERTLNAKYGTWDFYNYSFALQSYMYNKRYDMFDKIHDLIRKNDVTAYDAYRSALSKDANLNKEYQDYMQMLVDNREKCNVPLVSDDYLATHAPKPVSDIAAEITAEAKLNNVSVKKNKSQFFHTFTLQGTYTGTTAKGEYEDWKTITQNVNDTLKRLSAKEWTGYKTVTAYFVNYRVNASGQFEYDVVFHGINTEEGAVNKAPVAVINGPYSGNVNEAISFKSDGSKDEDGKILSYKWEFGDGTVSNEQNPTHVYTKEGTYTAKLTVTDDKGLTNTVTTNVTVQKKEDNSIEKEPNNSFQTANKLQFNQVLRASLGNGDTSDFFEINVETAKNLQINVTKENNIGVNWVLYSEADLNNYVTYAQQEGNKLVGSYYTYPGKYYLHVYQYGGGTGNYTVEVK

SEQ ID NO: 29820 - protein, 117 aa, Bacillus thuringiensis serovar tochigiensis BGSC 4Y1
MLGGTNIPLPNNQNIGPGITVSGGNTIFTVANAGNYYIAYTINLTAGLLVSSRITVNSSPLAGTINAPTVATGSFSATIIANLPAGAAVSLQLFGVVALATLSTATPGATLTIIRLS

SEQ ID NO: 29821 - protein, 122 aa, Bacillus thuringiensis serovar tochigiensis BGSC 4Y1
MKFKLPYGKYTYKETIAPNGYVINEETFAFEIKENGEIIKHIVKNKKEEKASLPSKPNKPTPNGEVKPSADVKPMQQPNTHNEVRLPATGGVGNEFTVLFVLGLGFIIAGAYVLKMKNRKEM

SEQ ID NO: 29822 - protein, 431 aa, Bacillus thuringiensis serovar tochigiensis BGSC 4Y1; identical to SEQ ID NO: 26106

SEQ ID NO: 29823 - protein, 222 aa, Bacillus thuringiensis serovar tochigiensis BGSC 4Y1
MGITGPTGVTGPTGVIGPTGVTGPTGTTGPTGVTGATGSTGPTGITGATGISGPTGVTGPTGVTGPTGSFSSFAYFAATNLNRISFNSTLPIDTIQIINGSDIGFIGPDTVTLEPGTYQVHYTHSGDSLGVPGTEVLAIELLLNGNPLTGSYIWGADPDTSSIDDFSHLQISNKILISILALSNLQIVNRSSGNGSGVFSNVANFLSGNNPVRTSLSILKIN

SEQ ID NO: 29824 - protein, 687 aa, Bacillus thuringiensis
  subsp. alesti
MKDAKADTKEKLNQPATGTPAATGPVKGGLNGKVPTSPAKQKAYNGDVRKDKVLVLLVEYADFKHNNIDKEPGYMYSEDFNKEHYEKMLYGDEPFALEDGSKIETFKQYYEEQSGGSYTVDGTVTKWLTVPGKAADYGADAATGHDNKGPKGPRDLVKDALKAAVDSGLDLSQFDQFDQYDVNGDGNQNQPDGLIDHLMIIHAGVGQEAGGGKLGDDAIWSHRWTVGPKPFAIEGTQAKVPYWGGKMAAFDYTIEPEDGAVGVNAHEYGHDLGLPDEYDTDYTGHGEPIQAWSVMSGGTWAGKIAGTTPTSFSPQNKEFFQKTIGGNWANIVEVDYEKLNKGIGLATYLDQSVTKSNRPGMIRVNLPDKDVKTIRPAFGKQYYYSTKGDNLHTTLETPLFDLTNATNAKFDFKSLYEIEAEYDFLEVHAVTEDGQKTLIERLGEKANSGNAEATNGKWIDKSYDLSQFKGKKVKLTFEYITDGGLALNGGLLDNASLTVDGKVTFSDDAEGTPQLKLDGFVVSSGTEKKKHNYYVEWRNHTGSDSALKFARGPEYNSGMVVWYADSAYADNWVGLHPGHGFLGVVDSHPEAIVGTLNGKPTIDSSTRFQIADAAFSFDKTPAWKVVSPTRGTYTYDGLAGVAKFDDSKTYINQQIPDAGRILPKLGLKFEVVGQADDNSAGAVRLYR

SEQ ID NO: 29825 - protein, 138 aa, Bacillus thuringiensis
  subsp. darmstadiensis
QIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYAVTMKA

SEQ ID NO: 29826 - protein, 259 aa, Bacillus thuringiensis; identical to SEQ ID NO: 29244
  subsp. darmstadiensis

SEQ ID NO: 29827 - protein, 816 aa, Bacillus thuringiensis
  subsp. finitimus
MAKTNSYKKVIAGTMTAAMVAGVVSPVAAAGKSFPDVPADHWGIDSINYLVEKGAVTGNDKGMFEPGKELTRAEAATMMAQILNLPIDKDAKPSFADSQGQWYTPFIAAVEKAGVIKGTGNGFEPNGKIDRVSMASLLVEAYKLDTKVNGTPATKFKDLETLNWGKEKANILVELGISVGTTADKWEPKKTVTKAEAAQFIAKTDKQFGTEVAKVESAKAVTTQKVEVKFSKAVEKLTKEDVKLANKANNDKVLVKDVKLSEDKKSATVELYSNLAAKQTYTVDVNKVGKVEVTVGSLEAKTIEMADQTVVADEPTALKYTVKDENGTEVVSPAGIEFVTPAAEKINAKGEITLAKGTSTTVKAVYKKDGKVVAESKEVKVSAEGTAVASISNWTVAAEKADFTSKDFKQNDKVYEGDNVSVQVELKDQFNNVVNNVKAEYESLNTEVAVVDKATGKVTVLSAGKAPVKVTVKDSKGKELVSKTVEIEAFAQKAMKEIKLEKTNVALSTKDVTDFKVKAPVLDQYGKEFAAPVEVKVLDKDGKELKEQKLVAKYENKELVLNAHGQEAGKYTVELTAKSGKKEVKSKLALELKAPGVFSKFDVRGLENELDKYVTEENKKNEMVVSVLPVDANGLVLREKEAATLKVTTTDKDGKVVDATSGQVAVNDAAGTITVGNEAKAGETYKVTVVADGKLITTHSFKVVDTAPAAKKLAVDFTSTSLNEVAQGSELKTALLNILSVDGVPATTAGATVTDVKFVSADTNVVSEETAKFGTKGSTSIFVKELTVKKGEQTQKVELDKPVRVDVSIKEVKEVK

SEQ ID NO: 29828 - protein, 333 aa, Bacillus thuringiensis
  subsp. finitimus
  strain YBT-020
MKGKLLKGVLSFGIGLGVLYGGSSAQADTSTDQNNTLKVMTHNVYMLSTNLYPNWGQSERADLIGAADYMKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 29829 - protein, 372 aa, Bacillus thuringiensis
  subsp. finitimus
  strain YBT-020
MKTKQTIAASTLALAMIAGANSAHAEVTDATPQQSTGDRLAEIKQHKQELDAKLQQHKENVDQTLNELNKVKENVDTKVNELHERKQVADEKINEMKQRKEEFDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEMKQAKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 29830 - protein, 696 aa, Bacillus thuringiensis
  subsp. finitimus
  strain YBT-020
MSSWLNNTNGYCSCNNQNGVHVDSCCFSCDGTVPKVGPTGPTGATGSTGATGPTGATGDIGPTGATGDTGPTGSTGSTGATGSTGSTGATGVTGSTGATGSTGSTGATGSTGPTGATGATGATGPTGSTGSTGITGSTGPTGATGATGATGPTGSTGSTGITGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGATGVTGSTGPTGVTGITGPTGSTGVTGSTGATGPTGATGPTGITGPTGATGITGATGPAGATGETGPTGSTGITGATGITGATGPTGATGITGPTGITGATGPTGATGVTGATGSTGPTGATGVTGSTGPTGATGVTGSTGPTGVTGITGPTGSTGVTGSTGATGPTGATGPTGITGPTGATGITGSTGPTGVTGITGPTGSTGVTGATGPTGATGITGATGITGPTGATGSTGSTGATGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGDAISLQLFGLLAVATLSTTTPGAVLTIIRLS

SEQ ID NO: 29831 - protein, 394 aa, Bacillus thuringiensis
  subsp. finitimus
  strain YBT-020
MEGNDENQKIQRLINSNFKLSPDLVGPTFPPVPTGMTGITGSTGATGVTGPTGSTGPTGSTGATGVTGPTGDTGATGDTGSTGSTGPTGVTGPTGNTGSTGNTGPTGSTGATGITGPTGSTGPTGSTGPTGNTGSTGVTGPTGATGPTGNTGSTGNTGPTGSTGATGNTGPTGSTGATGITGPTGSTGPTGNTGSTGNTGPTGSTGATGNTGPTGSTGSTGVTGPTGSTGATGVTGLTGSTGVTGDTGPTGSTGATGVSTTATYAFANNTSGSAISVLLGGTNVPLPNNQNIGPGITVSGGNTVFTVANAGNYYIAYTINLTASLLVSSRITVNGSPLAGTINSPAVATGSFNATIIANLPAGAAVSLQLFGVVAIATLSTTTPGATLTIIRLS

SEQ ID NO: 29832 - protein, 412 aa, Bacillus thuringiensis
  subsp. finitimus
  strain YBT-020
MKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQISSIKNVNNQLNKGKGKLSFSMNGNQLKATSSNAGYGISYEDKNWGIFVNGEKIYTFNEKTTVGNISNDINKLNIKGPYIEIKQI

SEQ ID NO: 29833 - protein, 146 aa, Bacillus thuringiensis
  subsp. finitimus
  strain YBT-020
MKFNKLVLGCGVISALTLGVLGNNTYAEEVNKMNDTIHFVEHIPTDILLTQTMDYSGEAITSFVYSGSENLSFFMKNNGQNTMGYSVKGPNMELIVGGYIKPGEQQINVTNVRNALSPLPIGTYSIYVSNDDGSKGQFQVAVRSMN

SEQ ID NO: 29834 - protein, 971 aa, Bacillus thuringiensis
  subsp. finitimus
  strain YBT-020
MKGYSKKVLVGVSFASLMLGSFQGDALAEGTKGEQVSYRNVLKMEPIGLQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGGAYTKDDSKGIETLVEVLRSGFYLGFYHTELSKLNERSYHDKCLPALQTIANNPNFKLGTLEQNRVVSSYGKLIGNASSDVETITAAAKIFKQYNDNFSAWVDNLSAGNAIYDIMQGVDYDIQSYLYDTRKAPKDTIWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGAIMLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKIVSYKWEFGDGTVSNEQNPTHVYTKEGTYTAKLTVTDDKGLTNTVTTNVTVQKKEDNSAEKEPNNSFQTANKLQLNQVLRASLGNGDTSDFFEINVETAKNLQINVTKENNIGVNWVLYSEADLNNYVTYAQQEGNKLVGSYYAYPGKYYLHVYQYGGGTGNYTVEVK

SEQ ID NO: 29835 - protein, 153 aa, Bacillus thuringiensis
  subsp. finitimus
  strain YBT-020
MFQGTNAGFQRIAGSPGIDSNVIPYVTAGTGSIVGFAASINVNNLPAAVYTINICRNVPTNLTAPTSSYILTTITLTTTDKITGTIVFSIKPTDTGSGQIQVFNPTPAVGPATVTWTSITTGNPVSRGDAISLYINPGITASAVYSIFLITDL

SEQ ID NO: 29836 - protein, 183 aa, Bacillus thuringiensis
  subsp. finitimus
  strain YBT-020
MKKLSILLTFILVLVSVTAACTQDKTDSAVENGPIEEPTAKNENEELINFEEKEDMSRLEQGILLVGESVKGGYYLTAVQSAYLNASNDSVVVNVSVKNVRGQTIGLSELKYNLKDEKDGKTYKGTVLDQNPSDIQVKPNETVELKIAFEVPGTADEYMFYIESSLDPLETYWKIDKLQSQTN

SEQ ID NO: 29837 - protein, 503 aa, Bacillus thuringiensis
  subsp. finitimus
  strain YBT-020
MFNKKMVAMAMTVPLVMGTITTVSALEKQQQVKLEAYSPQKKATEYLKENAAQYGLKADLSDLQYISTTETSVASYVRFQQVVNGAPVFSKQITVTLNGEGKGVLAVSDYQSVKGVKEVTTKISEKDAIQKSMAYVGEVSEQNLWAPTEKEFGYIVEEGIARPVYKVVVHSNNPFGAWETFVDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 29838 - protein, 305 aa, Bacillus thuringiensis
  subsp. finitimus
  strain YBT-020
MNIKQSFKLLAMFLSILFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASEELQEITMSVTPTEEQEAVLKNDFFETGLYTVETNAKSGTYKVQATGAPVGAKFVNEKGESKTEFNVGEKFRILIPKQTPAGGFSFKVIGKLTKLQGIAHKGTPTIQNAVVLLERSEEETSPELSVSWKKGNGHDNNKPHTPNEPHKPNQKR

SEQ ID NO: 29839 - protein, 431 aa, Bacillus thuringiensis; identical to SEQ ID NO: 26428
  subsp. finitimus
  strain YBT-020

SEQ ID NO: 29840 - protein, 455 aa, Bacillus thuringiensis
  subsp. finitimus
  strain YBT-020
MKNQFLKQLQNMKMNKKSLGAVALTAGIIGTTLIPQNAYAHGFVEKPSSRSALCSPTYGALNVNCGSVMYEPQSLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNGIQAQKVTAHSIELAWTASTDNVGVKGYQIFRNGEMVDTATGTHFIDKKLQPSTEYSYTVKAIDAAGNASKESAKLTVKTTVEAPDTEAPTQPKGLHSMGTTASSVDLMWSPSDDNIGVDHYDIYRETEGSMKKIAKSNTTAYIDKNLLSNTTYKYVVKAVDVAGNESVQSDIFTITTKTESASYEEWDATKAYEKGDRVLYEGKVYEAVQSYKGNGDPNWIYALSLWKTV

SEQ ID NO: 29841 - protein, 948 aa, Bacillus thuringiensis
  subsp. finitimus
  strain YBT-020
MKKSKKMLAGATLAIGVIAPQVLPATAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWTFKPIVADKLNTTFDSSPNAQKYIKKDGNISYVGPSENEFAKYAIDITKKNDDDKETGGENPTTPPTGEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTSEGNNGENPTTPPTGEGNNGENPTTPPTGEGNNGENPTTPPIDEGNNTGSGQTTTDNQNAKETTTVSEKKEERDLPKTGTSVVSTIGAGLAFVGAGFLLLFRRKKANR

SEQ ID NO: 29842 - protein, 965 aa, Bacillus thuringiensis
  subsp. finitimus
  strain YBT-020
MNKKSKINKVMLSISTMALSLGALQTHVVAEEKVPYNVLKTKPVGIEKSVDEIGHVSKAEETLSFQERLKVGDFSQRPASIPNKAAVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIANNPNFKLGTDEQDTVVSAYGKLISNASSDVETVQYAANILKQYNDNLHTYVDDRMKGQAVYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEALEQLAQKEWSGYKTVTAYFVNYRVNSSNEFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTESEPNNRPEEANRIGLNSTIKGSLIGGDHTDVYTFNVASAKDIDISVLNEYGIGMTWVLHHESDMQNYAAYGQANGNHIDAKMNAKPGKYYLYVYKYDNGDGTYELSIK

SEQ ID NO: 29843 - protein, 606 aa, Bacillus thuringiensis
  subsp. finitimus
  strain YBT-020
MEMQNHKLAGSPKNLIQGEEAIQRSGLVPEHVAKFIKIASDHNMYLLFRPVNLLSTSLIKGGAATKGLNVHGKSADWGPQAGYIPFDADISKVHGILSKVLKGNADNQLSLEETDPQGNKIIGKVVLNINEERLIELQNKNIINLGEWDERGNRIIESPNKIYDFRWNKESNRVQYKTKEGEKTVLEEQFDWRYIEVMGKLKNQKVTPLTADYDMFAMAPSLSEIKKQIPADEWRELVEEASSPIEKWRNITRLLIKYGLMRESDPEKGKLAEWQREIIDILNNAAIQAGYTGGTVVNHGTEQDNTDYPEQDPNIFIITPEKEVLLTESWDETIWFVETVIVGNPDDTFLFYANRSYNVIAAGSHAQILWNEPIPTPREFENERMELERVIGRKLPEEYSEEISEISNLLHLFYYPANQFVYFNRTYQEVSLFRAIQIFGKLKQLIDNEIPIEEYQIYFEILYARTLNHIKVILRIEGIALTITTLIRIIQSEDYEIVAFYKYLESVHQVDIYSQWNPKDKYGFGQFVQYNKVLYSAREWTQGDEPGKSRFWKLDTDYMIPWNQYMVFEYNNETIHKNRVYRAKEWTQDDEPGISLDMKWKLIYDR

SEQ ID NO: 29844 - protein, 10 aa, Bacillus thuringiensis
  subsp. galleriae
  MOD_RES (1)..(1): Any amino acid
  MOD_RES (9)..(9): Any amino acid
XGKTFPDVXP

SEQ ID NO: 29845 - protein, 252 aa, Bacillus thuringiensis
  subsp. israelensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNI

SEQ ID NO: 29846 - protein, 249 aa, Bacillus thuringiensis
  subsp. israelensis
MENLNHCPLEDIKVNPWKTPQSTARVITLRVEDPNEINNLLSINEIDNPNYILQAIMLANAFQNALVPTSTDFGDALRFSMAKGLEIANTITPMGAVVSYVDQNVTQTNNQVSVTINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 29847 - protein, 156 aa, Bacillus thuringiensis
  subsp. israelensis
NTFQGAIDPLTLNFNFEKALQIANGLPNAGVTGTINQSVIHQTIEVSVMISQIKEIIRSVLGLVINSANFWNRVVSAITNTFTNLEPQVDENWIVWRNLSATQTSYFYKILFSIQNEDTGRFMAILPIAFEITVDVQKQQLLFITIKDSARYEVKM

SEQ ID NO: 29848 - protein, 249 aa, Bacillus thuringiensis; identical to SEQ ID NO: 29252
  subsp. israelensis

SEQ ID NO: 29849 - protein, 393 aa, Bacillus thuringiensis
  subsp. israelensis
MIEPFFSLAVGLDSTVTRLYHQLIMACLLLIHLVSPLQRYSLYSTLSWIVTDLEASNSLEPSALFVAVVFNRRFYKPNCLTYIINVSMSCNYLTFSNKSSNTTTSLPCCSAPTKVNSNVTKPFFSFAVNFVSSCYFFSHQLIMVCLIALFISFLLPVYSLPTTKVSILHFVLFSDRILLNESLFHHQLCFELSFLLMRYRTILVTLYHCYQHVVVTTFPSFSNSSNTTTSFSSKPVASKVKSSCNKTIASVGVNFVSAVTSLPFTTNGFIALFIHYLPFTVYLTEILIHLSWIVTDLDDELAVGFWTDCFISSCCFYCWNLFIFDNVFNDLTILFNFKRERFFILIHNLLVQQFLYMCIFQMVHFKFSDSFIVCFSFYYFFSCFVINRKFCIW

SEQ ID NO: 29850 - protein, 278 aa, Bacillus thuringiensis
  subsp. israelensis
MKAGVKSPNPETIIDAEAPAALEVVATELPVANGIIKFDPVTPVGPVGPVSPVGPVSPVGPVSPVGPVSPVGPVSPVGPVSPVGPVSPVGPVSPVGPVSPVGPVSPVGPVSPVGPVSPVGPVSPVGPVCPVSPVGPVSPVGPVSPVGPVSPVGPVCPVSPVGPVSPVGPVSPVGPVSPVGPVSPVGPVSPVGPVSPVGPVSPVGPVSPVGPVSPVGPVSPVGPVSPVCPVSPVGPVSPVGPVSPVGPVIPVIPVKGGIGGNVGPIKLTFKFEKLLLNI

SEQ ID NO: 29851 - protein, 263 aa, Bacillus thuringiensis; identical to SEQ ID NO: 29242
  subsp. israelensis

SEQ ID NO: 29852 - protein, 263 aa, Bacillus thuringiensis; identical to SEQ ID NO: 29242
  subsp. israelensis

SEQ ID NO: 29853 - protein, 249 aa, Bacillus thuringiensis; identical to SEQ ID NO: 29252
  subsp. israelensis

SEQ ID NO: 29854 - protein, 525 aa, Bacillus thuringiensis; identical to SEQ ID NO: 29379
  subsp. israelensis

SEQ ID NO: 29855 - protein, 263 aa, Bacillus thuringiensis
  subsp. jegathesan
MYTKNLNSLEINEDYQYSRPIIKKPFRHITLTVPSSDIASFNEIFYLEPQYVAQALRLTNTFQAAIDPLTLNFDFEKALQIANGLPNAGITGTLNQSVIQQTIEISVMISQIKEIIRNVLGLVINSTNFWNSVLAAITNTFTNLEPQVDENWIVWRNLSATHTSYYYKILFSIQNEDTGAFMAVLPIAFEITVDVQKQQLLFITIRDSARYEVKMKALTVVQLLDSYNAPIIDVFNVHNYGLYQSNHPNHHILQNLNLNKIKG

SEQ ID NO: 29856 - protein, 455 aa, Bacillus thuringiensis
  subsp. konkukian
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWDPNKALTRADLEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVTGPHFIDKKLQPSTEYSYTVKAIDAAGNVSKESATLTVKTTVEAPDTEAPTQPKGLHSMGTTASSVDLMWSPSDDNIGIDHYDIYRETEGSMKKIATSNTTSYMDKYLLSNTTYKYVVKAIDVAGNESIQSDIFTITTKTENASYGEWDAKKAYEKGDRVLHEGKVYEAVQSYKGNGDPNWIYALSLWKTV

SEQ ID NO: 29857 - protein, 21 aa, Bacillus thuringiensis
  subsp. konkukian
LDTDLQGTMPEVYASERAAFL

SEQ ID NO: 29858 - protein, 43 aa, Bacillus thuringiensis
  subsp. konkukian
SATVELYSNLAAKGLAVEFTSTSLKAALLNILSVDGVPATTAK

SEQ ID NO: 29859 - protein, 3333 aa, Bacillus thuringiensis
  subsp. konkukian
  strain 97-27
MFKGGKMKKLFNICLIVFVLFSQFISFPYNQAKAETLKETSLFDTVEMKDATDQIIDEAKNPNNLIKIGSTIQVEYAWSIKDQQVVHANDTAVLQIPLALKVSKDLQGDLLTDQKNIGQYFITAKDNKLKLIFNDQVENSKDAKGKIKIDTVFNPTLKTEEKSVQIAFPLGTLVQPITVPIQVEDSKEDGTKQDTNKQVQDQVAKPTTDNPEQNPATKPATDNPEQNSATKPATDNPEQNPATKPATDNPEQNPATKPATDNPEQNPATKPVTDNPEQNPATKPAADNPEQNLASDPAEITNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNVQTATNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKSFQNNVTITSDNQGQQKASSTVTVSRGTHLNKTSKYDPKTQTIEWTITYNGDQRNIKKTDALLKDIFDDTHELDVNSIVVKNASYDDKGRLVTGDTVNNYTVTNKKNGFDLQFNEDINSAYVITYKTKPTDNVIKDGKIKNTVTADNGSSKENEAGFQQQNIIKSNNKAETNYKDKTTTWTITVNNNNYPLNNAIITDTFDHGGLQLKDKKLEIKDGDYTLQAETDYVLDVTDKGFKITLIGTYQSNMTKTLIVKYTTDFDYTKLESGKTSFKNTGNLSWIDSGSNPQSNKVEADFDPDTFTKANGYKYGSYNAQTKEITWIIGFNYNNVEIKDPYVIDVIQDKQKLVPGSIEVRHMILNGSPDNARPGDAVPIEQYELEEPTDKNKNTLQVHFKQSINSPYYIIFKTSLDGELIQNTYKNEAELKDFSKIVNTLKGDAQVNKGGSFVTKKAVQDDNYINWSIAINESQSTIADAVVTDDPTDNQVLVEDSFHLYPTTVDYYGNVTKDTANELKQGTDYKLTITTDNNTGKQHFEIAFLKKIDRAYILEYRSLINADDKEKVSNKAKIAGNQLTVKNTETVETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGSQETTTYKLANKKFVGKVVLTKSDDLNKNVTLQGAVFTLLDKDKKIISEHEKLTTNDQGQITVDHLKPGTYYLQETTAPEHYKLDSTPIQFTIKEDQTTVINRTATNSLIPGSAILTKVDKDGKTLAGAEFSVRDRHNNVIRGYEKLTTNDQGQIEATNLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTKPIEFTIDKSQQSFATVTATNSLKTGEVELLKVDEFGDKKPLAGAVFKIVDVNNNDVRTDLTTDADGKTKADKLRPGTYKFIETAAPEHYVLRAEPIEFTIDRSQKETLLVKAENALKPGDVELTKVDDIDGTALEGAVFKIVDANDEKKVIRENIKTGADGKAIATGLRPGDYKFIEVTAPKYYDKNTNPIKFTITESQTMSATVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGALVIPDLAPGDYQFIETAAPEHYKLDQTPIKFTIKKGSKDDLPVPVTVKNSLLTGGVTLTKVDDVDGTTLEGAEFIIVDAHDTEKVVRKGLTTDEHGKISASDLRPGDYQFIEVKAPKDYTLGNDPIPFTIGKSQKENITVTATNSLKKGAVTLTKIDDIDRTMLKGAIFKIVDMDGNEVRTNLGTDKNGKIHVPDLRPGDYQFIETKAPEHYVLDETPIPFTIERSQTKEINVTGKNTLKKGSVELTKIDDIDTDTKLANAVFNLLDADGEIVEEGLTTNAEGKIVVENLRPGTYQFVETIAPEHYDLNKTPIEFTIKKSQTETLHVTAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETKAPKHYDLNKEPIPFTIEKGQAEPISVTAKNSLTKGAVELSKVDDIDGTALEGAIFKIVDMNGHDVRTGITTDAKGKVSISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVEMKAPQDYDLNETPIPFTIEKSQSTHVSVTAKNGLTKGGVELTKIDSLDTKETLEGAVFKITDLNGNDIRTNLVTNKDGKIIAKDLPPGDYQFIETKAPKHYDLNETPIKFTIERSQTKHVFVTAINSLTKGSVELIKVDDVEENTTLEGAVFKIVNKDGHNVRTDLTTDKNGRLVVDELPPGDYEFIETKAPTHYKLNETPIKFTVKKGQEKIASVTATNSLTKGAVELSKVDDIDGSALKGAVFKIVDMNGNDVRTDLTTDKDGKISVSDLRPGDYQFVETKAPTHYDLNQTPINFTVEKSQTATASVTAKNSLTKGAVELTKVDDIDGTTLEGAIFKIVDMNGNDVRTDLTTDKDGKISVSDLRPGDYQFIETKAPTHYDLNQTPINFTVEKSQTATASVTAKNSLTKGAVELTKVDDIDGTTLEGAIFKIVDSNGHDVRTDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYYK

SEQ ID NO: 29860 - protein, 431 aa, Bacillus thuringiensis; identical to SEQ ID NO: 26106
  subsp. konkukian
  strain 97-27

SEQ ID NO: 29861 - protein, 148 aa, Bacillus thuringiensis; identical to SEQ ID NO: 26670
  subsp. konkukian
  strain 97-27

SEQ ID NO: 29862 - protein, 1055 aa, Bacillus thuringiensis
  subsp. konkukian
  strain 97-27
MVKVVEGNGGKSKIKSPLNSNFKILSDLVGPTFPPVPTGMTGITGSTGATGETGATGPTGATGETGSTGNTGATGATGPTGSTGVTGSTGATGSTGPTGNTGAMGNTGPTGETGVTGSTGPTGSTGATGNTGVTGSTGPTGETGATGPTGSTGAIGNTGATGETGSTGNTGPTGATGATGSTGPTGSTGVTGNTGATGSTGATGNTGPTGSTGVTGNTGATGAIGPTGSTGPTGETGVTGSTGPTGNTGVTGNTGPIGETGVTGSTGATGNTGATGSTGPTGETGVTGSTGPTGSTGATGNTGATGETGATGSTGVTGSTGATGSTGATGNTGATGETGPTGNTGVTGSTGPTGETGVTGSTGPTGNTGVTGSTGPTGNTGVTGSTGPTGETGVTGSTGPTGNTGVTGSTGPTGETGVTGSTGPTGNTGATGNTGPTGETGVTGSTGPTGSTGVTGNTGTTGSTGNTGPTGATGSTGPTGEAGATGSTGVTGSTGPTGETGATGSTGSTGETGATGSTGVTGSTGPTGETGATGSTGVTGSTGPTGETGATGSTGPTGNTGATGNTGPTGETGATGNTGPTGSTGVTGNTGATGETGPTGSTGATGETGSTGNTGPTGSTGVTGNTGATGSTGATGNTGPTGSTGETGATGNTGPTGETGVTGSTGPTGNTGATGETGETGVTGPTGSTGVTGSTGPTGSTGAPGNTGATGETGPTGNTGVTGSTGPTGSTGVTGNTGATGETGPTGSTGETGVTGNTGPTGETGVTGSTGATGNTGPTGETGATGETGATGSTGVIGSTGATGNTGATGNTGATGSTGPTGNTGATGSTGATGNTGPTGETGPTGSTGVTGNTGATGSTGVTGNTGATGATGATGSTGPTGSTGATGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 29863 - protein, 780 aa, Bacillus thuringiensis
  subsp. konkukian
  strain 97-27
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKGGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 29864 - protein, 971 aa, Bacillus thuringiensis
  subsp. konkukian
  strain 97-27
MKGYSKKVLVGVSFASLMLGGFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 29865 - protein, 265 aa, Bacillus thuringiensis
  subsp. konkukian
  strain 97-27
MSEKYIILHGTALEPNLIGPTLPPIPPFTFPTGPTGITGPTGATGFTGIGITGPTGITGPTGIGITGPTGVTGPTGIGITGPTGVTGPTGIGITGPTGVTGPTGIGITGPTGITGPTGIGITGPTGATGLGILPVFGTITTDVGIGFSVVVNTNINFTLPGPVSGTTLNPVDNSIIINTTGVYSVSFSIVFVIQAISSSILNLTINDSIQFAIESRIGGGPGVRATSARTDLLSLNQGDVLRVRIREATGDIIYSNASLVVSKVD

SEQ ID NO: 29866 - protein, 372 aa, Bacillus thuringiensis; identical to SEQ ID NO: 26664
  subsp. konkukian
  strain 97-27

SEQ ID NO: 29867 - protein, 455 aa, Bacillus thuringiensis; identical to SEQ ID NO: 29856
  subsp. konkukian
  strain 97-27

SEQ ID NO: 29868 - protein, 890 aa, Bacillus thuringiensis
  subsp. konkukian
  strain 97-27
MKNKKEIAIVALTTGLALTSVTPYGIGYAEETDQMQVDIQEDSFRTGELTKPSKKTPESVVKDALKEKTEHVLSPKQVSGDKGVDYKVLQKRGSYDGTTLLRLQQIYEGKEVYGHQLTAHVDKKGVIKSVSGDSAQNLAKEDLKNPINLSNEEAKQYIYTKYGNDIKFISEPEVKEVIFVDENRGQPTNAYQVTFAAATPNYVSGTYLVDAHSGDMLKNMVQESSLKVSEEHLESLKESKKSNSISLTGTGKDDLGITRSFGISEQSNGKYALADYTRGQGIETYDVNYRDINFEEKYYPGILATSTSTTFNDPRAVSAHFLATKVYDFYKDKYKRNSFDNKGKKVVSVVHAWHSGETDDPKNWGNAFSANINNVSMLIYGDPMVRAFDIAGHEFTHAVTSSESNLEFFGESGAINEALSDIMGTAIEKYVNNGEFNWTIGEQSGSVLRNMKNPSSVKFFNGVPYPDDYSKFSDLNGEDNEGVHFNSSIINKVAYLIAQGGTHNGVTVNGIGEDKMFDIFYYANTDELNMTSNFSELRLACLKVATNRYGVNSIEVEAVQKAFDAAKIKGTVKENEKTAENQVPELTVPLTITLRVGDTFDPMSNVKAIDKEDGDLSNRVEHKGDVDTSKPGKYIVEYSVVDSQGGNATATQTVIVEGNRETLDLNPTLTVPTEMTIHVGDSFDPMAKVLAMDKEDGDLTSKVKVNGEVNTSKSGTYVVTYTVTDSQGHEVTAKQTVTVKVREEVENELPILKVPATTTITKGDQFNPMAGVSVTDKEDGDLTSKVAYVGTIDTSKSGTFEIIYSVRDSVGNEVHTIQKVFVKDKDTRKANDLANNSNIPNNSNSDKNESTYKELPNTGASTTNSTIMGLWMVIVGTVLTLARKFRKVQK

SEQ ID NO: 29869 - protein, 412 aa, Bacillus thuringiensis
  subsp. konkukian
  strain 97-27
MKKAKGVVKSVAVASVIMSGSIGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMSSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 29870 - protein, 503 aa, Bacillus thuringiensis; identical to SEQ ID NO: 26407
  subsp. konkukian
  strain 97-27

SEQ ID NO: 29871 - protein, 179 aa, Bacillus thuringiensis
  subsp. konkukian
  strain 97-27
MFKKIATVTLAGTLAFGLSACDEKREVAKTVSNNTKEEQSSAKKENTKNEDTREYNVEKTTQIRNQKLTIHKVQIAQVAEYDKLEKGNEFVIVHVTVENIGNQKVRINPLDFYLERGDGSIVDHTFSTSNKNVFKIKDVDPNGKITGAITFEAKKGDSNLELIYRPDVMSKEEVKVELK

SEQ ID NO: 29872 - protein, 712 aa, Bacillus thuringiensis
  subsp. konkukian
  strain 97-27
MTIDSMKERNEKMNNKNKGKVFYGNDCCEVRACSHINISKSELTEFVRLLQALGQAIQAVFQNPSQTNIDNLIAALNNLQKFLNCLDLSPAQKQIGNSIIANLLTILRTTPFSCGALYVELQSLLNYLLYIAKLFKVDCCTIDKLVRLITEIQTILVQYGSGCLGGGGATGATGATGATGPQGPAGATGATGPQGPAGAQGATGPQGPQGPQGIQGPAGATGATGPQGVQGPAGATGAQGPQGVQGPAGATGATGAQGPQGVQGPAGATGPQGPQGIQGPAGATGATGATGAQGAQGPAGATGATGAQGPQGPAGATGATGAQGAQGPAGTTGATGPQGPQGVQGPAGATGATGPQGPQGPAGATGATGAQGAQGPAGATGATGPQGPQGIQGPAGATGATGAQGAQGPAGATGATGAQGPAGATGATGAQGAQGPAGATGPQGPQGIQGPAGATGATGAQGVQGPAGATGATGAQGAQGPAGATGATGAQGAQGPAGATGATGAQGAQGPAGATGATGAQGPAGATGPQGPQGIQGPAGATGPQGPQGIQGPAGATGPQGPQGIQGPAGATGATGPAGTPIPVTIAAIGNSNAQTISPGTNIQFNQVFEINNINFNDTADTLTILETGVYDISFSASTTFPGSSPFGFGISFNGQPPTRNFSTNVIGSAVSFSTIVTLEAGTTISVQPTANTISIPNTGDTTATLSVFRIY

SEQ ID NO: 29873 - protein, 336 aa, Bacillus thuringiensis
  subsp. konkukian
  strain 97-27
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRNSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKLFTLDWKNKKLVEKK

SEQ ID NO: 29874 - protein, 183 aa, Bacillus thuringiensis
  subsp. konkukian
  strain 97-27
MRKSFILLTLILVLVSVTAACTQDKKDSAVENSPIEEPTAKNENEELINFEEKEDMSRLEQGILLVGESIKGGYYLSAVHSAYLNDSNDSVVVNVSVKNIRGQTIGLSELKYNLKDEKDGKTYEGKVLDQNPSDIQVKPNETVELKIAFEVPSTADEYMFYIESSLDPLGAHWKIDKLQSQKN

SEQ ID NO: 29875 - protein, 378 aa, Bacillus thuringiensis
  subsp. konkukian
  strain 97-27
MHNVLLLDTFSFGLIRTEIVKDLKKVKSHNRVFGLFITIHMEVWNVKGKLLKGVLSFGIGLGVLYGGSSAQADTSTDQNNTLKVMTHNVYMLSTNLYPNWGQSERADLIGAADYIKNQDVVILNEVFDNSASNRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 29876 - protein, 965 aa, Bacillus thuringiensis
  subsp. konkukian
  strain 97-27
MNKKSKINKVMLSISTMALSLGALQAPVSAEEKVPYNVLKTKPVGIEKPVDEIGHISKAEETLSFQERLKVGDFSQRPASITNKATVKQVKESYSMADLNKMNDQELVETLGSIKWHQITDLFQFNEDAKAFYKDKRKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVATTKNIDISVLNEYGIGMTWVLHHESDMQNYAAYGQANGNHIEANFNAKPGKYYLYVYKYDNGDGTYELSVK

SEQ ID NO: 29877 - protein, 455 aa, Bacillus thuringiensis
  subsp. kurstaki
MNNRLLKQLQNMKMNKKSLGAVALTAGIIGTTLIPQNAYAHGFVEKPGSRSALCSPTYGALNVNCGSVMYEPQSLEAPKGFPQGGPVDGQIASAGGKFGGVLDQQTANRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNGIQAQKVTAHSVELAWTASTDNVGVKGYQIFRNGEMIDTVPGTHFIDKKLKPSTEYSYTIKAIDAAGNVSKESATLTVKTTVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 29878 - protein, 368 aa, Bacillus thuringiensis
  subsp. kurstaki
MQLCITIHSVLFSCYDINVIRHISTKIKGSDCMKRSKTYLKYLALSAVFASSAITLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 29879 - protein, 259 aa, Bacillus thuringiensis; identical to SEQ ID NO: 29244
  subsp. kyushuensis

SEQ ID NO: 29880 - protein, 250 aa, Bacillus thuringiensis
  subsp. medellin
MENPNHCPLEDIQVNPWKTPQSKARVITLRIDDPNEINNLLSINEIENTNYLLQAIMLANAFQKALVPTSTEFAEDALQFSMTKGLEVANTISPPGAVVQYVDQNVSQTNNQVSAMINKVLDVLKSILGVALGQSVIEQLTSAVTNTFTNLNTQKNEAWIFWGRETSTQTNYTYNVLFAIQNGQTGGVMYCVPVGFEIKVSAVKERVLFLTIQDSASYNVNIQSLKFAQPLVSASEYPIADLTSAINGTL

SEQ ID NO: 29881 - protein, 260 aa, Bacillus thuringiensis
  subsp. medellin
MYINNFDFPEKNNDYQCSGPIIKKPFRHIALTVPSSDITNFNEIFYVEPQYIAQALRLTNTFQGAIDPLTLNFNFEKALQIANGLPNAGVTGTLNQSVIHQTIEISVMISQIKEIIRSVLGLVINSANFWNNVVSAITNTFTNLEPQVDENWIVWRNLSANQTSYYYKILFSIQNEDTGRFMAVLPIAFEINVDVHKQQLLFITIKDSARYEVKMKALTVVQALDSYNAPIIDVFNIHNYSLHRPNYHILQNLNVNPIKS

SEQ ID NO: 29882 - protein, 249 aa, Bacillus thuringiensis
  subsp. morrisoni
MENLNHCPLEDIKVNPWKTPQSTARVITLRVEDPNEINNLLSINEIDNPNYILQAIMLANAFQNALVPTSTDFGDALRFSMAKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 29883 - protein, 265 aa, Bacillus thuringiensis
  subsp. neoleoensis
MKESIYYNEENEIQISQGNCFPEELGHNPWRQPQSTARVIYLKVKDPIDTTQLLEITEIENPNYVLQAIQLAAAFQDALVPTETEFGEAIRFSMPKGLEVAKTIQPKGAVVAYTDQTLSQSNNQVSVMIDRVISVLKTVMGVALSGSIITQLTAAITDTFTNLNTQKDSAWVFWGKETSHQTNYTYNVMFAIQNETTGRVMMCVPIGFEIRVFTDKRTVLFLTTKDYANYSVNIQTLRFAQPLIDSRALSINDLSEALRSSKYLY

SEQ ID NO: 29884 - protein, 157 aa, Bacillus thuringiensis; identical to SEQ ID NO: 29258
  subsp. tenebrionis

SEQ ID NO: 29885 - protein, 428 aa, Bacillus tusciae
  strain DSM 2912 / NBRC 15312 / T2
MNTTIYEITAREVLDSRGNPTVEVEVELEGGATGRAIVPSGASTGAHEAVELRDGGERYGGKGVRKAVEHVNETIGPELIGQDALDQVGIDRLMIDLDGTPNKGRLGANAILGVSMAVAHAASQAVGLPLYVYLGGFAARTLPVPMMNILNGGKHADNNVDIQEFMILPVGASTFREALRMGAEVFHALKKVLSEKGLATAVGDEGGFAPSLGSNEEALQVIVRAVEKAGYRPGEDVMLAVDVASSELYKDGRYVFAGEGVTRTAEEMIAFYERLIAKYPIVSVEDGLAEDDWEGWEALTARLGKKVQLVGDDLFVTNTSRLRTGIDRGVANSILVKVNQIGTLTETFEAIEMAKRSGYTAVISHRSGETEDVTIADIAVAAQTGQIKTGAPSRTDRVAKYNQLLRIEDALTYTGRYAGRDAFYNLRG

SEQ ID NO: 29886 - protein, 239 aa, Bacillus tusciae
  strain DSM 2912 / NBRC 15312 / T2
MKRFWKLWIGATAILALLVGGAASAAAPLFHGLQTTRVVLDGKEIKADVPAVILEGRTLLPVRALAEALGLQVSWDAQNQTALLKSNKQTCAHSFTTPEGITYTIQGVFADIEDKTAKPAPTATVSVISTITNNSKKPYDLGQAHIWLGDAGSKDSSTRIEGKIVSQKGEPASGSLAPSESTRVWILFNVPADQSGSPNLKPVFGTWTGGHFEPYLNTCPNGHWVEIYPRPNDPTPVWV

SEQ ID NO: 29887 - protein, 168 aa, Bacillus virus 1
MGISAANRGMAFEHLVEYTNRCYRMKGMAHIEKVPTPWKVIRQGQRIISAFPEKKGMVDFIGIAHGRVIAFDAKSTRERTRFPLDNIEDHQMAFLKSWRDQGAITFFLVEFAKKHEVYILRFSDAEKWWVQAKQGGRKSIPYQWFVKHCDLVKSSRGIPLDYLRCLER

SEQ ID NO: 29888 - protein, 242 aa, Bacillus weihenstephanensis
MKGKLLKGVLSFGIGLAALYSGSSVQAEMSTNQNDTLKVMTHNVYMLSTNLYPNWGQNERADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMF

SEQ ID NO: 29889 - protein, 333 aa, Bacillus weihenstephanensis
  strain KBAB4
MKGKLLKGVLSFGIGLAALYSGSSVQAEMSTNQNDTLKVMTHNVYMLSTNLYPNWGQNERADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSNSEYASMFKTLHASVPSYTGHTATWDATTNSIAKYNYPDAPAEHLDYIIASKDHANPSFVENNVLQVKSPKWSVTSWFKKYTYDDYSDHYPVEATISMK

SEQ ID NO: 29890 - protein, 455 aa, Bacillus weihenstephanensis
  strain KBAB4
MNNRILKHLQNMKMNKKSLGAVALTAGIIGTTLIPQNAYAHGFVEKPGSRSALCSPTYGVLNMNCGSVMYEPQSLEAPKGFPQGGPVDGQIASAGGKFGGILDQQTADRWFKNTITGGENTFTWKYTAPHLTSQWHYYITKKNWNPNKPLTRADFEPIGTVQHDGSAASNNLNHKINVPTDRSGYHVILAVWDVADTANAFYNVIDVNLVNNEKPDTEAPSNPNGLEARKVTANSVELAWNASTDNVGVKGYQVLRNGEIIDTVPGTHFIDKQLQPSTEYSYTVKAIDAAGNVSKVSTAVKVKTSVATLDTEAPTQPKGLHSMGTTASSVDLMWSPSDDNDGVDHYDIYREISGVMKKIGISNTTSHMDKNLLANTTYKYTVKAVDVAGNESAQSDVFTVTTKTESASYEAWDSKKAYKKGDRVVHEGKVYEAVQNYQGNGDPNWIYALSLWKTV

SEQ ID NO: 29891 - protein, 326 aa, Bacillus weihenstephanensis
  strain KBAB4
MDSKNIGPTFPPLPSINFPTGATGATGATGETGATGATGATGVTGETGATGATGETGATGATGVTGETGATGVTGETGATGATGVTGETGATRATGVTGETGATGATGVTGITGETGITGETGATGVTGETGATGATGATGVTGETGATGATGVTGETGATGATGVTGITGITGETGITGETGATGATGETGITGETGITGVTGATGATGATGETGITGVTGATGETGETGITGPTGIPGTIPTTNLLYFTFSDGEKLIYTNADGIAQYGTTQILSPSEVSYINLFINGILQPQPFYEVTAGQLILLDAEPPSQGSSIILQFIIIN

SEQ ID NO: 29892 - protein, 433 aa, Bacillus weihenstephanensis
  strain KBAB4
MSNNNCFGHNNCNPIVFSADCCKNPQSVPITSQQLSQLITLLNSLISAISAFFANPSNANRLALLDLFNQFLIFLNSLLPSPEVNFLKQLTQSIIVLLQSPAPNLGQLSTLLQQFYSALAQFFFALDLIPISCNSNIDPATLQVLFGLLIQLINATPGATGPTGPTGPTGPTGPTGATGGGATGATGATGATGATGATGATGATGATGGGATGATGATGATGATGATGATGATGATGATGATGATGATGATGATGATGATGATGATGVTGGGAIIPFASGTTPSALVNALIANTGTLLGFGFSQPGVALTGGTSITLALGIGSYAFVAPRAGTITSLAGFFSATAALAPLSPVQVQIQILTAPAASNTFTVQGAPLLLAPAFAVIAIGATASGIIPEAIPVAAGDKVLLYVSLTAASPIAAVAGFVSAGINIV

SEQ ID NO: 29893 - protein, 299 aa, Bacillus weihenstephanensis
  strain KBAB4
MFDKNEIQKINGILQANALNPNLIGPTLPPIPPFTLPTGPTGVTGPTGVTGPTGVTGPTGVTGPTGVTGPTGVTGPTGVTGPTGVTGPTGVTGPTGVTGPTGVTGPTGVTGPTGVTGPTGVTGPTGETGPTGGTEGCLCDCCVLPMQSVLQQLIGETVILGTIADTPNTPPLFFLFTITSVNDFLVTVTDGTTTFVVNISDVTGVGFLPPGPPITLLPPTDVGCECECRERPIRQLLDAFIGSTVSLLASNGSIAADFSVEQTGLGIVLGTLPINPTTTVRFAISTCKITAVNITPITM

SEQ ID NO: 29894 - protein, 458 aa, Bacillus weihenstephanensis; identical to SEQ ID NO: 27568
  strain KBAB4

SEQ ID NO: 29895 - protein, 185 aa, Bacillus weihenstephanensis
  strain KBAB4
MRKSSILLTLILVLVSVTAACTQDKQDSAVENGSIEEPAAKNVNEELINFEEEEKEDISRLEQGILLVGESAKGGYYLATVQSAYLNDSNDSIVVNVSVKNVRGQMIGLSELKYNLKDEKDGKAYEGKVIDQNPSDIQVNPNETVELKIAFEVPGTTDEYMFYIESSLDPLETNWKIDKLQSQKN

SEQ ID NO: 29896 - protein, 455 aa, Bacillus weihenstephanensis
  strain KBAB4
MNNRFLKQLQNLKMNKKSIGAVALTAGIIGTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGLQAQKVTANSIELTWNTSTDNVGMKGYQVFRNGEMIDTVLGTHFINKQLKPSTEYTYTVKAIDTAGNVSKESTALTVKTTVEAPDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKGDRVLHEGKVYEAVQNYEGHGDPNWIFALSLWKTV

SEQ ID NO: 29897 - protein, 260 aa, Bacillus weihenstephanensis
  strain KBAB4
MSKFKKKFHIPCECFGPPLPPPEIGPTGPTGPTGPTGPTGPTGPTGPTGPTGPTGPTGPTGPTGPTGPTGPTGPTAVGCCPCTNVLDNPGFDELPIITDPVPGWNQTGDVTEVGFPNAHSGRILSNGTLSLLAASIEPGGSINQSVDVGEGCCFTLSFAADVRDNAFLIASVSFPELGHGCPPLATTLGSLNIPHIIPVGNQPQSLFQHYILVVCIPPGVTTACISFQNTATGGEGATAFVDNVVFQPTGGPCTSCSQNF

SEQ ID NO: 29898 - protein, 369 aa, Bacillus weihenstephanensis
  strain KBAB4
MSLWSNNANGYCGCNNQNGLHVDSCCFSCDGTVPKLGPTGPTGATGDTGATGDTGATGSTGATGATGVTGATGITGATGITGATGATGSTGATGATGITGATGATGPTGATGSTGATGATGATGATGATGATGVTGATGATGATGSTGPTGATGATGATGATGATGVTGATGATGATGSTGPTGPTGPTGATGATGATGPTGPTGATGATGPTGPTGATGATGETGATGVTGTSITATYAFANNTSGAAISVLLGGTNVPLPNNQNIGPGITVSGGNTVFTAANAGNYYISYTINITASLLVSSRITINGAPLAGTINSPALATTSFSATIITTLAAGSAISLQLFGLLAVATLSTTTPGAVLTIIRLS

SEQ ID NO: 29899 - protein, 292 aa, Bacillus weihenstephanensis
  strain KBAB4
MSNNNYSDGLNPDEFLSASAFDPNLVGPTLPPIPPFTLPTGPTGPTGPTGPTGPTVPTGPTGPTGPTGPTGPTGDTGTTGATGDTGATGDTGATGPTGPTGDTGATGPTGPTGDTGATGPTGPTGDTGATGPTGPTGDTGATGATGPTGPTGPTGPSGLGLPAGLYAFNSATISLALGINDPVPFNTVGSQFGTAISQLDADTFIISETGFYKITVIAYTAAVSILGSLAIQVNGVNIPGAGTSLISLGAPLVIQAITQITITPSMVEAVVTGLGLSLALGTSASIIIEKIA

SEQ ID NO: 29900 - protein, 878 aa, Bacillus weihenstephanensis
  strain KBAB4
MVKYSKISKLILGVGLVTISCNGLQIQAETKEKNVKSVLQMEPVGIQKSVDELAHSSTVQENASFTKRLKLSDLSQRPLAPNEDVKPLAEEKKYSMAELNQLSNKQLTDLLVTIKWYQIPELFQFNSDSLKFYQDDSRMQAIINKLAEQGQTYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVNRFALIGTVTNKNGWLINNGIYYAGRLGKLYSTPTKGQQVVTEAMRIYPHLGEQYFVAAEQITTNYGGVDANGKTISLDQIREEGKKKYLPKTYTFDDGAIVFKTGDKVSEEKIKRLYWAAKEVRSQFYRTVGSDKPLESGHVDDVLTMVIYNSPDEYQFNRQLYGYETNNGGMYIEGTGTFFTYERTPEQSIYSLEELFRHEFTHYLQGRYEVQGLWGQGEMYQNERLTWFEEGNAEFFAGSTRLDSVVPRKSIIGGLSYDPAKRYTAAQTLNAKYGTWDFYNYSFALQSYMYNNRPEMFDKVHDLIRANDVSSYDAYRSTLSKDNKLNEDYQSYMQMLIDNRDKYTIPQVSDEYLAQHDPKSISDVTSDITNEAKLKDVKVTKNKSQFFNTFTLQGTYTGSAAKGEIEDWKVMNQATNDMLKRLSGKEWTGYKTLTAYFVNYRVNNAGQFEYDIVFSGVNTEEGTAVEKEPNNSFDTANPLSLNTLLRGNLSDQDQGDKFVIDVKDQKDLQISVTNEQNLGMNWVLYSESDLNNYVAYATKRDGNKLLGNYNAKPGKYYLSVYKYGGGTGNYTVQVK

SEQ ID NO: 29901 - protein, 374 aa, Bacillus weihenstephanensis
  strain KBAB4
MKTKQTIAASTLALAMIAGANSAHAEVTDATPQQSTGDRLAEIKQHKQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQSKQTQTDNNNTTVPAKNNARELPNAGSEQSNNMALGMLSVLGGVLLITRNKIKTLFSK

SEQ ID NO: 29902 - protein, 934 aa, Bacillus weihenstephanensis
  strain KBAB4
MKERDRQNSLNSNFRISPNLIGPTFPPVPTGFTGIGITGPTGPQGPTGPQGPRGFQGPMGEMGPTGPQGVQGIQGPAGQMGATGPEGQQGPQGLRGPQGETGATGPQGVQGLQGPIGPTGATGAQGIQGIQGLQGPIGATGPEGPQGIQGVQGVPGATGSQGIQGAQGIQGPQGPSGNTGATGVTGQGISGPTGITGPTGITGPSGGPPGPTGATGATGPGGGPSGSTGATGATGNTGVTGSAGVTGNTGSTGSTGETGAQGLQGIQGVQGPIGPTGPEGPQGIQGIPGPTGVTGEQGIQGVQGIQGITGATGDQGPQGIQGAIGPQGITGATGDQGPQGIQGVPGPTGDTGSQGVQGIQGPMGDIGPTGPEGPEGLQGPQGIQGVPGPAGATGPEGPQGIQGIQGPIGVTGPEGPQGIQGIQGIQGITGATGAQGATGVQGVQGNIGATGPEGPQGVQGTQGDIGPTGPMGPQGVQGIQGIQGPTGAQGVQGPQGIQGIQGPTGVTGDTGTTGATGEGTTGATGVTGPSGVTGPSGGPAGPTGPTGPSGPTGLTGPSGGPPGPTGATGVTGGVGDTGATGSTGVTGATGVTGATGATGLQGPQGIQGVQGDIGPTGPQGVQGPQGIQGITGATGDQGPQGIQGPQGIQGPTGPQGIQGGQGPQGIQGATGATGAQGPQGIQGIQGVQGPTGPQGPTGIQGVQGEIGPTGPQGVQGLQGPQGPTGDTGPTGPQGPQGIQGPTGATGATGSQGIQGPTGATGATGSQGIQGPTGATGATGATGATGATGATGATGVTGVSTTATYSFANNTSGSAISVLLGGTNIPLPNNQNIGPGITVSGGNTVFTVTNAGNYYIAYTINITAALLVSSRITVNGSPLAGTINSPAVATGSFNATIISNLAAGSAISLQLFGLLAVATLSTTTPGATLTIIRLS

SEQ ID NO: 29903 - protein, 329 aa, Bacillus weihenstephanensis
  strain KBAB4
MYQRNCFSCDGRRNSGSIGATGPTGATGPTGNAGPTGAGLQSTTAFSLAAAPNYKKGQVVTYTSSGYVVKKDAPQGFPNVSQDYIVLVEGGSTGSTGSTGSTGTTGSTGSTGSTGSTGSTGSTGSTGTTGVTGSTGATGTTGVTGSTGSTGTTGVTGSTGSTGTTGPAGSSTAKSIVFQGTNAGFQRIAGSPGIDSNVIPYVTAGAGNIVGFATSININNLPAAVYTIDICRNVPTNLSAPTSSYILSTIALTTTDKITGTMTFSIKPTDIGSRQPQVYNPTPAPGPATVTWTSITTGNLFSRGDAISLYITPGITASAVYSIFLITDI

SEQ ID NO: 29904 - protein, 474 aa, Bacillus weihenstephanensis
  strain KBAB4
MNNKNRGKVFFGNDCCEVRACSFINISKSELKEFIKILQALGQNIKDIFQNPSQSNIDKLIATLDNLQKSLKCLDLSPAQEKIGTSIITHLLTILKTKPFSCGALYVELQSLLNFLLYIAKLFKVNYCTIDKLIKLIIEIQTILVKYGSGCLGGGATGATGPQGLRGVTGATGATGPQGLRGVTGATGATGPQGLRGATGATGATGPQGLRGATGATGTTGPQGLRGVTGATGATGPQGLRGVTGATGATGPQGLRGVTGATGATGPQGLRGVTGATGATGPQGLRGVTGATGATGPQGLRGVTGATGATGPQGLRGVTGATGATGATGPQGLRGATGPSGKPLPVTIAAIGNSNPQTISPGTNIQFNQVFELNNLIFNDTSDTLTILETGVYDISFSASTTFPGSSPFGFGISFNGQPPTRNFSTNVIGSAVSFSTIVTLTAGTTISVQPTVNTISIPNTGDTTATLSVFRIY

SEQ ID NO: 29905 - protein, 164 aa, Bacillus weihenstephanensis; identical to SEQ ID NO: 27564
  strain KBAB4

SEQ ID NO: 29906 - protein, 234 aa, Bacillus weihenstephanensis
  strain KBAB4
MSKENIILHGPALEPNLIGPTLPPIPPFTFPTGPTGITGPTGATGFTGIGITGPTGIIGPTGIGITGPTGVTGITGIGITGPTGATGIGITGPTGATGLGILPVFGTITSEVGIGFSAVVNTNVNLTIPGPVSGTTLTPVDNSITIDTTGVYSVSFSIVFVIQAISSSILNLTINDSIQFAIETRVGGGSGVRTTSARTDLLPLNQGDVLRVRIREATGDIIYSNASLVVSKVD

SEQ ID NO: 29907 - protein, 971 aa, Bacillus weihenstephanensis; identical to SEQ ID NO: 27561
  strain KBAB4

SEQ ID NO: 29908 - protein, 431 aa, Bacillus weihenstephanensis; identical to SEQ ID NO: 26715
  strain KBAB4

SEQ ID NO: 29909 - protein, 936 aa, Bacillus weihenstephanensis
  strain KBAB4
MSRFNDNQNKYSNPCFPTSAGRIPTTPTIPITKAQIRTFRAIINDLIKIIPKLFANPSPKNIENLIDTLHLLSKFICSLDTTSALKAQGLAIIKNLITILKNPTFVASAVFVELQILINYLLYITKLFRIDPCTLQELLKLIAELQTTLVNSASFGRGPTGPTGPRGNTGATGATGPRGNTGATGATGPRGNTGATGATGPRGNTGATGATGPRGNTGATGATGPRGNTGATGATGPRGNTGATGATGPRGNTGATGATGPRGNTGATGATGPRGNTGATGAIGPRGNTGATGATGPRGNTGATGATGPRGNTGATGATGPRGNTGATGSTGPQGAQGNTGATGPQGVQGNTGATGPQGAQGNTGATGPQGVQGNTGATGSTGPQGLQGNTGATGSTGPQGAQGNTGATGPQGVQGNTGATGSTGPQGLQGNTGATGSTGPQGLQGNTGATGSTGPQGAQGNTGATGPQGVQGNTGATGSTGPQGVQGNTGATGSTGPQGVQGNTGATGPQGVQGNTGATGSTGPQGVQGNTGATGPQGAQGNTGATGPQGVQGNTGATGSTGPQGVQGNTGATGPQGVQGNTGATGSTGPQGVQGNTGATGPQGAQGNTGATGPQGVQGNTGATGSTGPQGVQGNTGATGPQGTQGNTGATGPQGAQGNTGATGPQGAQGNTGATGIGVTGPTGPSGGPPGPTGPQGIQGNTGATGPQGVQGNTGATGPQGAQGNTGATGPQGAQGNTGATGPQGAQGNTGATGPQGAQGNTGATGIGVTGPTGPQGNTGATGPQGVQGPTGATGIGVTGPTGPSFPVATIVVTNNIQQTVIQFNNFIFSTAINVNNIIFNGTNTVTVINAGIYVISVSISTTAPGCAPLGVGISINGAVATDNFSSNLIGDSLSFTTIETLAAGANISVQSTLNEITIPATGNTNIRLTVFRIA

SEQ ID NO: 29910 - protein, 289 aa, Bacillus weihenstephanensis
  strain KBAB4
MFDKNEMKKTNEVLQANALDPNIIGPTLPPIPPFTLPTGPTGPTGPTGPTGPTGPTGPTGPTGPTGPTGPTGPTGPTGLTGPTGPTGLTGPTGLTGPTGPTGLTGQTGSTGPTGATEGCLCDCCVFPMQEVLRQLVGQTVILATIADAPNVAPRFFLFNITSVNDFLVTVTDPVSNTTFVVNISDVIGVGFSLTVPPLTLLPPADLGCECDCRERPIRELLDTLIGSTVNLLVSNGSIATGFNVEQTALGIVIGTLPIPINPPPPTLFRFAISTCKITAVDITPTPTAT

SEQ ID NO: 29911 - protein, 385 aa, Bacillus weihenstephanensis
  strain KBAB4
MSKFKKNCHTPFPCALPLPQIGPTGITGATGFTGPTGITGATGPSGGPPGPTGPTGITGATGPSGGPPGPTGPTGITGATGPSGGPPGPTGPTGITGATGPSGGPPGPTGPTGITGATGPSGGPPGPIGPTGITGATGPSGGPPGPTGPTGITGATGPSGGPPGPTGPTGITGATGATGPSGGPPGPTGPTGITGATGPSGGPPGPTGPTGITGATGPSGGPPGPTGPTGITGATGSTGSTGPSGLTTSGLSQYAYVFNTVAQVVALEAPILFNSHGKITSGFTHTLGTSQMTVINAGDYKISFSVSGVEPNQFALFLNGAPVTNSVYGSGAGTQQNNGQTVLNLAAGDILTLNNHTSAAAVTLQTLAGGTQTNINASIVIEKLN

SEQ ID NO: 29912 - protein, 503 aa, Bacillus weihenstephanensis
  strain KBAB4
MLNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHAAEIDRIWTARGISTN

SEQ ID NO: 29913 - protein, 965 aa, Bacillus weihenstephanensis; identical to SEQ ID NO: 27569
  strain KBAB4

SEQ ID NO: 29914 - protein, 660 aa, Bacillus weihenstephanensis
  strain KBAB4
MIIQKTRRSFNKVIIITAACSMFSMFGTSISHTKAETHSAAPAVYVSPQNIPASDIISIDWSPVQTAPYTYWAVHNWNAGGEAGGYAGFQQQSGFDENGKRTLHFAIWDPISSKEAIKAEYLSPNSQAGLFGGEGTGLKVQTTYGWKDYNWYRMTMRSWQEDGHTKFGQWMKDVTKNKWHLIAIMDFPVANVAFNHGLGMFQEDWADSGQNVREARLKNGYSRKLVDKQWSSWNNQNISGTHDNTYQYDGGATSEYVWVKAGGNTQSTIGSGKIFTLNQPTQPEIGKLDFDIQSIYYENEKLNVSWKLKENSTPQFKGKIEIYNNENMTGQPINVIDDIKSYQNGISQSISLPTNAYAKIVLTDLFDQTVEKKVQIKNQSPNIFEGNEFAWSLKGIGDFEFAKVNLNRSIEEIQIALKAGVPHNYFDSTYASIKVQNTSGKVVYNKEIYGNKQQNAEQVKVPVKVGDFIEFTHLEGANRATITNMEKNIQESFGNKAVYEITKEGLKKVDNIVNPKPDTEAPTQPQGLYASNVTSNSIELKWNPSTDNVGVKEYQVLRDGQLIQTVQGTTFTDQNLTVNKEYKYAVKAVDAAGNTSIQSDILPVKTKNQNESYEKWDPKKAYTKGDKVEHQGKIYEAVQNHQGNGDPNWIFALALWNPLT

SEQ ID NO: 29915 - protein, 749 aa, Bacillus weihenstephanensis
  strain KBAB4
MKRVQKQKTKNLVMITATLSMFATGVTPSLEVFAEEQAQQKKVSTTLLQNENSVNVENRVFVVPGKGDVSQLQNIERRERNFSAYEPTGLYAKPNEQIIIQVQGNQSIQAYIGTFSFDASWREDSKIKSFTLNPGTNTIQSPNGGMIYFYNKQQGGTIQTTVTTGGAATPLFELGKHTKQDLINMLNQYPNAHAVELKGERVLITASPARVKKYLIGSNTDPVQLLKKMDEATRIQDKISGLSEEQVDKHYLHYVEDNHSLDYYMYAYPHRTAYVGDAIQHVLDINKFTNDGWGPWHEAGHMRQQAPWNFKNMTEVQVNLYSLAVEKAFTSNQPFRLQQEGAYTKAFQYLEQSNKNYDEISDAFVKLVMLWQLQLAYGEDFYPKLHQLYRDMPLNEIPQTDETKKQLFMISSSKVAKQNLIPFFEKWGLRPNNDTIQKVAALGYPNLTAEIWKSTDSNPVKPDTPNFSNILEGNQFAWSLKGIGDFEFAKVNLNKSTEEMQIALKAGVPHNYFDSTYASIKVQNTSGKVVYNKEIYGNKQQNAEQVKVPVKVGDFIEFTHLEGANRATITNMEKNIQETFGNKAVYEITKEGLKKVDKIVNPKPDTEAPTQPQGLYASNVTSNSVELKWNPSTDNVGVKEYQVLRDGQLIQTVKGTTFTDQNLTVNKEYKYTVKAVDAAGNTSIQSNILPVKTKDQNVSYEKWDPKKAYTKGDKVEHQGRVYEAVQNHQGNGDQNWIFALSLWKPITIK

SEQ ID NO: 29916 - protein, 878 aa, Bacillus weihenstephanensis
  strain KBAB4
MVKYSRISKLIVGVGLVTISCSGLQIQAETKEKNVKNVLQMEPVGLRKSVDELAHPSNVQENGSFTKRLKLADLSQRPPMPNENAKQLVEEKKYSMAELNQLSNKQLTDLLVTIQWYQIPELFQFNNDSLKFYQDDSRMQAIIAKLAEQGQAYTKDDSKGIETLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEINRFALIGTVTDKNGWLINNGIYYASRFGKFYSTPTKGQQVVTEAMGIYPYLGQQYFAAAEQIATNYGGIDANGKTVNLDQIREDGKKHYLPKTYTFDDGAIVFKAGDKVSEEKIKRLYWAAKEVRSQYYRTVGSDKPLESGHADDVLTMVIYNSPDEYQFNRQLYGYETNNGGIYIEGTGTFFTYERTPQQSIYSLEELFRHEFTHYLQGRYEVPGLWGQGEMYQNERLTWFEEGNAEFFAGSTRLDSVVPRKSIIGGLSNDPSKRYTAAQTLNAKYGTWDFYNYSFALQSYMYNNRPDMFDKVHDLIRTNDVPGYDAYRSTLSKDNKLNEEYQTYMQMLIDNRDKYTIPQVSDDYVAQHNPKPLSDVASDITNEAKLKNVKVTKNKSQFFNTFTLQGTYTGSAAKGENEDWKVMNQATNDMLKHLAEKEWSGYKTLNAYFVNYRVNAAGQFEYDVVFSGVNTEEGTAVEKEPNNSFDAANPLSLNALLRGNLSDQDQVDRFVIDVKDPKDLQITVTNEQNLGLNWVLYSESDLNNYVTYATKRDGNKLLGNYNAKPGKYYLSVYKYGGGTGNFTVEVK

SEQ ID NO: 29917 - protein, 787 aa, Bacillus weihenstephanensis
  strain KBAB4
MKFIKGIFVSTIALTAFTGLELIKFHENPNVVYADSKGPVKNISQSEADIKEEDQIIVKFKSEVNFPYKDGLEKQIKNEDSDLELVKIFSEFPQLTLKRLFTSVDPKEIENIDKHTRETENNSSSNLLDYYIVEVPNKVTAETLMDKFKKSYLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKVGNIGIASKAKVKVVSQIRGDGSYNTADAIINAVHNLQAGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTKSQNPLTDKIGVLPDLKSILSNLGYSPDISNNVLEGNQFVWSMKGIGDFEFAKLDFNKTKEEMQIQLKAGVPHHYFDSTYASVKVQNSSGKVVYNKDIYGNRQQNAETQKISMKVGDYIEFTHLEGGNRATLINVDKNIQESFGKKIVYQVTVNGLKKVDQIINPSPDTEAPTRPEGLQAANITANSVELKWNSSTDNVGVKEYQVLRDGKFIQMVQGTTFTDSKLTANIEYKYTVKAIDAAGNQSIQSSVLSIKTKEQNTSYEKWDPRKAYTKGDRVEYQGKIYEAVQSYQGNGDSNWIFSLSLWKTISIS

SEQ ID NO: 29918 - protein, 721 aa, Bacillus weihenstephanensis
  strain KBAB4
MKKLKPALSVLGSVSMALTLAYPALADIKQPNAGSTIEMFKEDANAKEGKDLIYGTDGKKGKMSTEKIEIQNNDWDQDGISNDLEIRGYKIEFNRQTGKNEAQAWDPERDKDKLKFITNPMSANSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSTKINEFIDNSRGDQVIVAKENLENAKKSYVSKGAKVGVFTKIQQPELSYSAYDPFTKKFYAAVVPGLFGASNEVSVSFENKKSKQTQQVTLLRKGNVYESKEAVSLNDFNPSQKVTFEINDAQKKLPIQKISTVVTYNKEYENYLTHRFSDELIVEGTPYTMKASGNPVLSYKGNDKWQYLAYAGNYTQPVNVIIERKGQPKPGQPIKKGEDIHIKVQNSAYSGYEYLKLQNGYIHFDQKQNASTFKFNHIHSPGSLDYQREWNLQSDGNNIGLDKGGSGYVTYGNDVHTGSSLNRWSFDKAK

SEQ ID NO: 29919 - protein, 247 aa, Bacillus weihenstephanensis
  strain KBAB4
MFLGGGYMERKNKWYGLNSNVNLSASSFDPNLVGPTLPPISPISVPTGPTGETGITGPTGPTGPTGPTGVTGITGPTGPTGATGITGPTGPTGETGITGPTGPGPTVSLKFLYVANFNENTVEIYDIFNPIFPVRIGEFNGGNLANPAGLAITGTTLYVTNNGDNTVEIYDILNPIAPVHVGEFNGGNLSEPDGLAITGTTLYVANFNDNTVEIYDILNPIAPVRVGEFNAGNLSSPAGLIIFSLFG

SEQ ID NO: 29920 - protein, 172 aa, Bacillus weihenstephanensis
  strain KBAB4
MKKLLASATAITLLTMGYSSAAFAEKNPNDKNCGHFKNKQEVMEFWHSNGYSATNDPHDLDRDNDGLPCEVKKGDYDQFIASKQTTKKDETKPQEQVKQEDTKKEPVKQENTQQNNKATNNKQEQTAVKAETKKQGEKLPNTASNGVTMMLASAALVLAGSVLVFRRKKTNA

SEQ ID NO: 29921 - protein, 692 aa, Brevibacillus brevis
  Bacillus brevis
MITPSFIISSFLSLPTVVEASVTNKVNYSKDVIYQIVTDRFSDGNPANNPSGAIFSQNCSDLHKYCGGDWQGIINKMNDGYLTDLGITALWISQPVENVYALHPSGYTSYHGYWARDYKKTNPYFGNFSDFDRLVSTAHNKGIKIIMDFTPNHSSLALETNPNYVENGALYNNGALLGNYSNDRNKLFHHNGGTDFSSYEDSIYRNLYDLADYDLNNKVVDQYLKESIKLWLIKIDGIRVDAVKHMSEGWQTSLMSDIYTYKPVFTFGEWFLGTGEVDPQNHHFANESGMSLLDFQFGQTIRSVLKDRTSNWYDFNEMIKSTEKDYDEVIDQVTFIDNHDMSRFSMVVFNFQTDIALAVLLTSRGVPTIYYGTEQYLTGGNDPDNRKPMKTFDRSTNSYKITSKLASLRQRNSALGYGNTTERWINSDVYIYERKFGNSIVLTAVNSSNRNQTISNLNTSLPQGNYTDELQQLLDGNTITVNANGSANSPQLQANSVAVWQVTKESTSPLIGHVGPMIGKTGNTVTVSGEGFGDKKGSVLFGSTSAEIVSWSNTEIQVKVPNVTAGHYNLSVVNATNTKSPAYEKFEVLSGNQVSVRFAVNNATTNSGTNVYIVGNVSELGNWDPNKAIGPMFNQVMYKYPTWYYDISVPAGKNLEYKYIKKDHNGNVTWQSGNNRTYTSPATGTDTVISNW

SEQ ID NO: 29922 - protein, 527 aa, Brevibacillus brevis
  Bacillus brevis
MKKSYLATSLTLSIAVGVSGFTSVPAFAKTKIDYHKQWDTPQYIGEVWEPEGAKGDDVVWSYLEKYKDEFRIQGNVEDHFEIVNEARNKETDTKHYRLQEVYNGIPIYGFQQTVHIDADGNVTSFLGQFIPDLDSNKQLKKKPKLNEQKAVKQAIKDVEGEVGEKPDFIQDPEAKLYIYVHEDESYLAYAVELNFLDPEPGRWMYFIDAHSGDVINKYNMLDHVTATGKGVLGDTKQFETTKQGSTYMLKDTTRGKGIETYTANNRTSLPGTLMTDSDNYWTDGAAVDAHAHAQKTYDYFRNVHNRNSYDGNGAVIRSTVHYSTRYNNAFWNGSQMVYGDGDGTTFLPLSGGLDVVAHELTHAVTERTAGLVYQNESGALNESMSDIFGAMVDNDDWLMGEDIYTPGRSGDALRSLQDPAAYGDPDHYSKRYTGSQDNGGVHTNSGINNKAAYLLAEGGTHYGVRVNGIGRTDTAKIYYHALTHYLTPYSNFSAMRRAAVLSATDLFGANSRQVQAVNAAYDAVGVK

SEQ ID NO: 29923 - protein, 96 aa, Brevibacillus brevis
  Bacillus brevis
NSVLASALALTVAPMAFANSDSESPLSHDGYSLHDGVSMYIEALDKFVNQHLCGSHLVEALYLVCGERGFFYTPKGIVEQCCTSICSLYQLENYCN

SEQ ID NO: 29924 - protein, 460 aa, Brevibacillus laterosporus
  Bacillus laterosporus
MKRMEERLFMVSKKLQLITKTLVFSTVLSIPLLNNSEIKAEQLNMNSQIKYPNFQNINIADKPVDFKEDKEKAREWGKEKEKEWKLTATEKGKINDFLDDKDGLKTKYKEINFSKNFEYETELKELEKINTMLDKANLTNSIVTYKNVEPTTIGFNQSLIEGNQINAEAQQKFKEQFLGQDIKFDSYLDMHLTEQNVSSKERVILKVTVPSGKGSTPTKAGVVLNNNEYKMLIDNGYVLHVENITKVVKKGQECLQVEGTLKKSLDFKNDSDGKGDSWGKKNYKEWSDTLTTDQRKDLNDYGARGYTEINKYLREGGTGNTELEEKIKNISDALEKNPIPENITVYRYCGMAEFGYPIKPEAPSVQDFEERFLDTIKEEKGYMSTSLSSDATSFGARKIILRLQVPKGSSGAYVAGLDGFKPAEKEILIDKGSKYRIDKVTEVVVKGTRKLVVDATLLTK

SEQ ID NO: 29925 - protein, 785 aa, Brevibacillus laterosporus
  Bacillus laterosporus
MTYMKKKLVSVVTCALLAPMFLNGNVNPVYADNQTNQLSTAQENQEKEVDRKGLLGYYFKGKEFNHLTLFAPTRDNTLIYDQQTVDFLLDKKQQEYQSIRWIGLIQSKETGDFTFNLSDDKNAIIEIDGKTISHKGQNKQVVHLEKGKLVPIKIEYQSDQIVNRDSKIFKEFKLFKVDSQQQSHQVQLDELRNPEFNKKETQQFLEKASKTNIFTQNMKRDEDATDTDGDSIPDLWEENGYTIQNKVAVKWDDSFAAKGYTKFVSNPFDSHTVGDPYTDYEKAARDLDLANAKETFNPLVAAFPSVNVNLEKVILSPNEDLSNSVESHSSTNWSYTNTEGASIEAGSGPLGISYGVSANYQHSETVAKEWGTSTGNTSQFNTASAGYLNANVRYNNVGTGAIYEVKPTTGFVLDNDTVATITAKSNSTALSISPGESYPKKGQNGIAINTMDDFNSHPITLNKQQLDQIFNNKPLMLETNQADGVYKIKDTSGNIVTGGEWNGVIQQIQAKTASIIVDTGEGVSEKRVAAKDYDNPEDKTPSLSLKEALKLGYPEEIKEKDGLLYYNDKPIYESSVMTYLDENTAKEVKEQLNDITGKFKDVKQLFDVKLTPKMNFTIKLATLYDGAEDGSSPTDVGISSPLGEWAFKPDINNVEGGNTGKRQYQLSKNKDGYYYGMLALSPEVSNKLKKNYQYYISMSIKADAGVEPTVTVMDNLLNGIVDKKLKLSSNGYQRFDILVDNSESHPINVMVIDLGVSSQDYNNYSKNIYIDDITITEVSAMKVKN

SEQ ID NO: 29926 - protein, 457 aa, Brevibacillus laterosporus
  Bacillus laterosporus
MIVIIFTNVKGGNELKKNFYKNLICMSALLLAMPISSNVTYAYGSEKVDYLVKTTNNTEDFKEDKEKAKEWGKEKEKEWKLTVTEKTRMNNFLDNKNDIKKNYKEITFSMAGSFEDEIKDLKEIDKMFDKANLSSSIVTYKNVEPSTIGFNKPLTEGNTINTDVQAQFKEQFLGKDIKFDSYLDTHLTAQNVSSKERIILQVTVPSGKGSTIPTKAGVILNNNEYKMLIDNGYVLHVDNISKVVKKGYECLQIQGTLKKSLDFKNDINAEAHRWGMKNYEGWAKNLTDPQREALDGYARQDYKQINDYLRNQGGSGNEKLDTQIKNISEALEKQPIPENITVYRWCGMAEFGYQISDPLPSLKEMEEKFLNTMKEDKGYMSTSLSSERLSAFGSRKFILRLQVPKGSTGAYLSAIGGFASEKEILIDKDSNYHIDKITEVVIKGVKRYVVDATLLTK

SEQ ID NO: 29927 - protein, 871 aa, Brevibacillus laterosporus
  Bacillus laterosporus
MKYMKKGLSSVVIGTLFASMFLNGNVNAVYANSKTNQIATTTQASKDNQIDREGLLGYYFKGKDFNDLTLFAPTRDNTLIYDQQTANTLVDQKHQEYHSIRWIGLIQSSATGDFTFKLSDDENAIIELDGKVISEKGNNKQSVHLEKGQLVQIKIEYQSDDALHIDNKIFKELKLFKIDSQNHSQQVQQDELRNPEFNKKETQVFLKKASKTNLFTQKTKRDIDEDTDTDGDSIPDVWEENGYTIQNKVAVKWDDSLASKGYQKFTSNPLEAHTVGDPYSDYEKAARDMPLSNAKETFNPLVAAFPSVNVSLEKVILSKNEDLSHSVESSQSTNWSYTNTEGVNVNAGWSGLGPSFGVSVNYQHSETVANEWGSATNDGTHINGAESAYLNANVRYNNVGTGAIYETKPTTSFILDGTTIGTIKAKENTTALTILPDQSYPEKGKNGIAINTMDDFNSRPIPLNKEQLNTYLSNKKPILLETDQVEGKYAIKDTNGNITIAGDWNGITDEISAKTASIIVDNGNQMSEKRVAAKDYTNPEDKTPNLSVKEALKLAYPDEIEEKDGLLFYNDQPIFEASVQSYVDEYTAKQIRKQLNDSTGSFKDVKNLYDVKLEPKMNFTIKTSTLYDGGESDNTKIGNWYYTYVVNGGNTGKKQYRSANKGAFTELSTESKNKLKKNIDYYVSLYMKADSKVSVDIEIDGKQESIVTDNITLDHVGYQRINILVPNLEGNEINTISIKGDGQTNVYWDDVSFVEVGAEEIEYKDPVPQFDIIEGDFDFFGDPLAVKYHDATYFIDSPLITQTPGTFSFTYKVIGEQTKTVLDSGSGKNANRINLDFKNVKSDRSFLYTLSCKDDLWGSTRTAVVRIFAVD

SEQ ID NO: 29928 - protein, 548 aa, Geobacillus stearothermophilus
  Bacillus stearothermophilus
MNKRAMLGAIGLAFGLLAAPIGASAKGESIVWNEQWKTPSFVSGSLLNGGEQALEELVYQYVDRENGTFRLGGRARDRLALIGKQTDELGHTVMRFEQRHHGIPVYGTMLAAHVKDGELIALSGSLIPNLDGQPRLKKAKTVTVQQAEAIAEQDVTETVTKERPTTENGERTRLVIYPTDGTARLAYEVNVRFLTPVPGNWVYIIDATDGAILNKFNQIDSRQPGGGQPVAGASTVGVGRGVLGDQKYINTTYSSYYGYYYLQDNTRGSGIFTYDGRNRTVLPGSLWTDGDNQFTASYDAAAVDAHYYAGVVYDYYKNVHGRLSYDGSNAAIRSTVHYGRGYNNAFWNGSQMVYGDGDGQTFLPFSGGIDVVGHELTHAVTDYTAGLVYQNESGAINEAMSDIFGTLVEFYANRNPDWEIGEDIYTPGVAGDALRSMSDPAKYGDPDHYSKRYTGTQDNGGVHTNSGIINKAAYLLSQGGVHYGVSVNGIGRDKMGKIFYRALVYYLTPTSNFSQLRAACVQAAADLYGSTSQEVNSVKQAFNAVGVY

SEQ ID NO: 29929 - protein, 381 aa, Geobacillus stearothermophilus
  Bacillus stearothermophilus
MRSKKLWISLLFALTLIFTMAFSNMSVQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPSGSTALKTVVDKAVSSGIVVAAAAGNEGSSGSSSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 29930 - protein, 711 aa, Geobacillus stearothermophilus
  Bacillus stearothermophilus
MRRWLSLVLSMSFVFSAIFIVSDTQKVTVEAAGNLNKVNFTSDVVYQIVVDRFVDGNTSNNPSGALFSSGCTNLRKYCGGDWQGIINKINDGYLTDMGVTAIWISQPVENVFSVMNDASGSASYHGYWARDFKKPNPFFGTLSDFQRLVDAAHAKGIKVIIDFAPNHTSPASETNPSYMENGRLYDNGTLLGGYTNDANMYFHHNGGTTFSSLEDGIYRNLFDLADLNHQNPVIDRYLKDAVKMWIDMGIDGIRMDAVKHMPFGWQKSLMDEIDNYRPVFTFGEWFLSENEVDANNHYFANESGMSLLDFRFGQKLRQVLRNNSDNWYGFNQMIQDTASAYDEVLDQVTFIDNHDMDRFMIDGGDPRKVDMALAVLLTSRGVPNIYYGTEQYMTGNGDPNNRKMMSSFNKNTRAYQVIQKLSSLRRNNPALAYGDTEQRWINGDVYVYERQFGKDVVLVAVNRSSSSNYSITGLFTALPAGTYTDQLGGLLDGNTIQVGSNGSVNAFDLGPGEVGVWAYSATESTPIIGHVGPMMGQVGHQVTIDGEGFGTNTGTVKFGTTAANVVSWSNNQIVVAVPNVSPGKYNITVQSSSGQTSAAYDNFEVLTNDQVSVRFVVNNATTNLGQNIYIVGNVYELGNWDTSKAIGPMFNQVVYSYPTWYIDVSVPEGKTIEFKFIKKDSQGNVTWESGSNHVYTTPTNTTGKIIVDWQN

SEQ ID NO: 29931 - protein, 1228 aa, Geobacillus stearothermophilus
  Bacillus stearothermophilus
MDRKKAVKLATASAIAASAFVAANPNASEAATDVATVVSQAKAQFKKAYYTYSHTVTETGEFPNINDVYAEYNKAKKRYRDAVALVNKAGGAKKDAYLADLQKEYETYVFKANPKSGEARVATYIDAYNYATKLDEMRQELEAAVQAKDLEKAEQYYHKIPYEIKTRTVILDRVYGKTTRDLLRSTFKAKAQELRDSLIYDITVAMKAREVQDAVKAGNLDKAKAAVDQINQYLPKVTDAFKTELTEVAKKALDADEAALTPKVESVSAINTQNKAVELTAVPVNGTLKLQLSAAANEDTVNVNTVRIYKVDGNIPFALNTADVSLSTDGKTITVDASTPFENNTEYKVVVKGIKDKNGKEFKEDAFTFKLRNDAVVTQVFGTNVTNNTSVNLAAGTFDTDDTLTVVFDKLLAPETVNSSNVTITDVETGKRIPVIASTSGSTITITLKEALVTGKQYKLAINNVKTLTGYNAEAYELVFTANASAPTVATAPTTLGGTTLSTGSLTTNVWGKLAGGVNEAGTYYPGLQFTTTFATKLDESTLADNFVLVEKESGTVVASELKYNADAKMVTLVPKADLKENTIYQIKIKKGLKSDKGIELGTVNEKTYEFKTQDLTAPTVISVTSKNGDAGLKVTEAQEFTVKFSENLNTFNATTVSGSTITYGQVAVVKAGANLSALTASDIIPASVEAVTGQDGTYKVKVAANQLERNQGYKLVVFGKGATAPVKDAANANTLATNYIYTFTTEGQDVTAPTVTKVFKGDSLKDADAVTTLTNVDAGQKFTIQFSEELKTSSGSLVGGKVTVEKLTNNGWVDAGTGTTVSVAPKTDANGKVTAAVVTLTGLDNNDKDAKLRLVVDKSSTDGIADVAGNVIKEKDILIRYNSWRHTVASVKAAADKDGQNASAAFPTSTAIDTTKSLLVEFNETDLAEVKPENIVVKDAAGNAVAGTVTALDGSTNKFVFTPSQELKAGTVYSVTIDGVRDKVGNTISKYITSFKTVSANPTLSSISIADGAVNVDRSKTITIEFSDSVPNPTITLKKADGTSFTNYTLVNVNNENKTYKIVFHKGVTLDEFTQYELAVSKDFQTGTDIDSKVTFITGSVATDEVKPALVGVGSWNGTSYTQDAAATRLRSVADFVAEPVALQFSEGIDLTNATVTVTNITDDKTVEVISKESVDADHDAGATKETLVINTVTPLVLDNSKTYKIVVSGVKDAAGNVADTITFYIK

SEQ ID NO: 29932 - protein, 407 aa, Geobacillus stearothermophilus
  Bacillus stearothermophilus
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQAARKYGGDNIKLYMNDYNTEVEPKRTALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 29933 - protein, 254 aa, Geobacillus stearothermophilus
  Bacillus stearothermophilus
MVVWALVMPSVPTKGLAETIRSGIDRVEPKEEPPKVPQAPKRDLKPGEIIEERTENTKVYYNGDGTFTKKIYFEPIHVKKKGQKIFEEVSSSLTDSTNNTNYVETENTILETNFYKKMVDGEYANFHYNGYSISYSILEAAGNDVQSIKAKDVAAVYKKKDNKILHKNIFPSIDLQNITFNESTKEDLVLHSVGYHIFKFRLKTDLQADIQDDGSILLTNQEHEKVFELPKPFMVDSNVDEHSGEVQRLRECNV

SEQ ID NO: 29934 - protein, 551 aa, Geobacillus stearothermophilus
  Bacillus stearothermophilus
MKRKMKMKLVRFGLAAGLAAQVFFLPYNALASTEHVTWNQQFQTPQFISGDLLKVNGTSPEELVYQYVEKNENKFKFHENAKDTLQLKEKKNDNLGFTFMRFQQTYKGIPVFGAVVTAHVKDGTLTALSGTLIPNLDTKGSLKSGKKLSEKQARDIAEKDLVANVTKEVPEYEQGKDTEFVVYVNGDEASLAYVVNLNFLTPEPGNWLYIIDAVDGKILNKFNQLDAAKPGDVKSITGTSTVGVGRGVLGDQKNINTTYSTYYYLQDNTRGNGIFTYDAKYRTTLPGSLWADADNQFFASYDAPAVDAHYYAGVTYDYYKNVHNRLSYDGNNAAIRSSVHYSQGYNNAFWNGSQMVYGDGDGQTFIPLSGGIDVVAHELTHAVTDYTAGLIYQNESGAINEAISDIFGTLVEFYANKNPDWEIGEDVYTPGISGDSLRSMSDPAKYGDPDHYSKRYTGTQDNGGVHINSGIINKAAYLISQGGTHYGVSVVGIGRDKLGKIFYRALTQYLTPTSNFSQLRAAAVQSATDLYGSTSQEVASVKQAFDAVGVK

SEQ ID NO: 29935 - protein, 705 aa, Geobacillus stearothermophilus
  Bacillus stearothermophilus
MPTNLFFNAHHSPVGAFASFTLGFPGKSGGLDLELARPPRQNVLIGVESLHESGLYHVLPFLETAEEDESKRYDIENPDPNPQKPNILIPFAKEEIQREFHVATDTWKAGDLTFTIYSPVKAVPNPETADEEELKLALVPAVIVEMTIDNTNGTRARRAFFGFEGTDPYTSMRRIDDTCPQLRGVGQGRILSIVSKDEGVRSALHFSMEDILTAQLEENWTFGLGKVGALIVDVPAGEKKTYQFAVCFYRGGYVTAGMDASYFYTRFFQNIEEVGLYALEQAEVLKEQSFRSNKLIEKEWLSDDQTFMMAHAIRSYYGNTQLLEHEGKPIWVVNEGEYRMMNTFDLTVDQLFFELKLNPWTVKNVLDLYVERYSYEDRVRFPGEETEYPSGISFTHDMGVANTFSRPHYSSYELYGISGCFSHMTHEQLVNWVLCAAVYIEQTKDWAWRDKRLAILEQCLESMVRRDHPDPEQRNGVMGLDSTRTMGGAEITTYDSLDVSLGQARNNLYLAGKCWAAYVALEKLFRDVGKEELAALAGEQAEKCAATIVSHVTDDGYIPAIMGEGNDSKIIPAIEGLVFPYFTNCHEALDENGRFGAYIQALRNHLQYVLREGICLFPDGGWKISSTSNNSWLSKIYLCQFIARHILGWEWDEQGKRADAAHVAWLTHPTLSIWSWSDQIIAGEITGSKYYPRGVTSILWLEEGE

SEQ ID NO: 29936 - protein, 618 aa, Geobacillus stearothermophilus
  Bacillus stearothermophilus
MSVEQEVINLGKNIFFNAHHSPMGCSPVFTLGYPGQSGGFDLELGSPPNQNIYIGLQDDGQERYRAFPFFGEGLDERDRYTTDESDSGSSERHSVQQEESGLIIPYNRDEIVRRFGAAIDEWQAGDLTFRLISPFEGVPDPETATEEQLRFALMPAVLAEITVDNTRGTSTRKAFFGLQNNDPVSAIRRLEDVTGGRICGIGQGRHTAIARAIRDYQRRIFYDGIDSQAKGSGKPPVWPWSGRAVLMDTPAGEKATYRFGLCFYRPVRHNRNRCSYYYSRYFANIEEVAEYALAQFNRKLEVARQADALVNDAKLSEDQKFIVAHAIRSYYGSTELLEHDGKPLWIVNEGEYRMMNTFDLLVDQLFYELKMNPWTVKNELDLYTSRYSYRDTVDFPGDATEYPGGISFTHDMGVANSFSLPGYSSYELHAIDDCFSHMTHEQLVNWVLSATVYVHQTNDREWLEPQPADSGASLDSMVNRDHPDPSQRTGMMGLDSSRTMGGRKSPPIQPGRLVGASAEQHLFAGKSWAAYVAMEKLFRDNGRKSAAALAGRQPELGAGTITSHLLPGGIFQPSFRRTMTPRSSLRSRVLSSRYTPDAKKRWIQTADSVHILRRCPRI

SEQ ID NO: 29937 - protein, 204 aa, Geobacillus stearothermophilus
  Bacillus stearothermophilus
LVSESNPGRAIPAGGKGATIRAARPGLATTLNGPKAGNGTTGATKLTTPARPLSEGANMMCDHRAGGNAAISGSSVGEGTARAGDSKVMSRMLSPKGSIIAGTVNMMPADIAAGSVRTPSSLPPDGRSATPMSVSEVASDISHKDGSVNVTKDPVTAAGLTAMRKNANKGSPPASPLPLKADNKGVHINKHWVDLKNDNDFNTR

SEQ ID NO: 29938 - protein, 473 aa, Geobacillus stearothermophilus
  Bacillus stearothermophilus
MNIKKFAKQATVLTFTTALLAGGATQAFAKETNQKPYKETYGISHITRHDMLQIPEQQKNEKYQVPEFDSSTIKNISSAKGLDVWDSWPLQNADGTVANYHGYHIVFALAGDPKNADDTSIYMFYQKVGETSIDSWKTPGRVFKDSDKFDANDSILKDQTQEWSGSATFTSDGKIRLFYTDFSGKHYGKQTLTTAQVNVSASDSSLNINGVEDYKSIFDGDSKTYQNVQQFIDEGNYSSGDNHTLRDPHYVEDKGHKYLVFEANTGTEDGYQGEESLFNKAYYGKSTSFFRQESQKLLQSDKNRTAELANGALGMIELNDDYTLKKVMKPLIASNTVTDEIERANVFKMNGKWYLSTDSRGSQMTIDGITSNDIYMLGYVSNSLTGPYKPLNKTGLVLKMDLDPNDVTFTYSHFAVPQATGNNVVITSYMTNRGFYADKQSTFAPSFLLNIQGKKTSVVKASILDQGQLTVNQ

SEQ ID NO: 29939 - protein, 452 aa, Geobacillus stearothermophilus
  Bacillus stearothermophilus
MRRRKQNWLFWLLSICLCLTFGPFQQTVKAESAPLDIRADAAILVDAQTGRILYEKNIDTVLGIASMTKMMTEYLLLDAIKAKRVKWDQMYTPSDYVYRLSQDRALSNVPLRKDGKYTVRELYEAMAIYSANGATVAIAEIIAGSEKNFVKMMNDKAKELGLKDYKFVNATGLSNKDLKGFHPEGTSTNEENVMSARAMAMLAYRLLKDHPEVLKTASIPHKVFREGTKDEIKMDNWNWMLPGLVYGYEGVDGLKTGYTEFAGNCFTGTAKRNGVRLISVVMNAKDASGKTTKEARFKETEKLFNYGFNQYSLETLYPKGYQLKGKETLPVVKGKEKEVRVATGKNLDLLVKNGEEKQYKPVYVLDKKKMTKEGKLVAPLKKGETVGYMTLEYKGDDSLAFLSPDMQKNIRVPLVTTAEVEKANWFVLSMRAVGGLFVDLWTSVAKTVKGWL

SEQ ID NO: 29940 - protein, 679 aa, Geobacillus stearothermophilus
  Bacillus stearothermophilus
MTAGYEPCWLRYERKDQYSRLRFEEIVAKRTSPIFQAVVEELQKGLRSMMEIEPQVVQEVNETANSIWLGTLEDEEFERPLEGTLVHPEGYVIRSDVDDGPFRIYIIGKTDAGVLYGVFHFLRLLQMGENIAQLSIIEQPKNRLRMINHWDNMDGSIERGYAGRSIFFVDDQFVKQNQRIKDYARLLASVGINAISINNVNVHKTETKLITDHFLPDVAEVADIFRTYGIKTFLSINYASPIEIGGLPTADPLDPEVRRWWKETAKRIYQYIPDFGGFVVKADSEFRPGPFTYGRDHAEGANMLAEALAPFGGLVIWRCFVYNCQQDWRDRTTDRAKAAYDHFKPLDGQFRENVILQIKNGPMDFQVREPVSPLFGAMPKTNQMMEVQITQEYTGQQKHLCFLIPQWKEVLDFDTYAKGKGSEVKKVIDGSLFDYRYSGIAGVSNIGSDPNWTGHTLAQANLYGFGRLAWNPDLSAEEIANEWVVQTFGDDSQVVETISWMLLSSWRIYENYTSPLGVGWMVNPGHHYGPNVDGYEYSHWGTYHYADRDGIGVDRTVATGTGYTAQYFPENAAMYESLDTCPDELLLFFHHVPYTHRLHSGETVIQHIYNTHFEGVEQAKQLRKRWEQLKGKIDEKRYHDVLERLTIQVEHAKEWRDVINTYFYRKSGIDDQYGRKIYR

SEQ ID NO: 29941 - protein, 679 aa, Geobacillus stearothermophilus
  Bacillus stearothermophilus
MTAGYEPCWLRYERKDQYSRLRFEEIVAKRTSPIFQAAVEELQKGLRSMMEIEPQVVQEVNETANSIWLGTLEDEEFERPLEGTLVHPEGYVIRSDVDDGPFRIYIIGKTDAGVLYGVFHFLRLLQMGENIAQLSIIEQPKNRLRMINHWDNMDGSIERGYAGRSIFFVDDQFVKQNQRIKDYARLLASVGINAISINNVNVHKTETKLITDHFLPDVAEVADIFRTYGIKTFLSINYASPIEIGGLPTADPLDPEVRWWWKETAKRIYQYIPDFGGFVVKADSEFRPGPFTYGRDHAEGANMLAEALAPFGGLVIWRCFVYNCQQDWRDRTTDRAKAAYDHFKPLDGQFRENVILQIKNGPMDFQVREPVSPLFGAMPKTNQMMEVQITQEYTGQQKHLCFLIPQWKEVLDFDTYAKGKGSEVKKVIDGSLFDYRYSGIAGVSNIGSDPNWTGHTLAQANLYGFGRLAWNPDLSAEEIANEWVVQTFGDDSQVVETISWMLLSSWRIYENYTSPLGVGWMVNPGHHYGPNVDGYEYSHWGTYHYADRDGIGVDRTVATGTGYTAQYFPENAAMYESLDTCPDELLLFFHHVPYTHRLHSGETVIQHIYNTHFEGVEQAKQLRKRWEQLKGKIDEKRYHDVLERLTIQVEHAKEWRDVINTYFYRKSGIDDQYGRKIYR

SEQ ID NO: 29942 - protein, 691 aa, Geobacillus stearothermophilus
  Bacillus stearothermophilus
MELEANHRQADPCWLRYAPVDHPERLAQYRKWCKELVTPANPSPLLASAIFELHQGIESMLHMKPQCVAVPAEAYSLCLGVKGQSALIDEALAPLADASEDSYVIRTISQDGRKHLLMAGVSERGALCSAFHLLRLMQMGESMEVINMQESPDNGLRMINQWDKLDGSIERGYAGGSIFYKNNEIPSHLTRVHEYARLLASTGINAIAINNVNVHERESWLIKLPMLSQVARIADIFRNYGITVFLSVNFASPIVVGHLPTADPLDEDVIAWWKQTAAEIYEVVPDFGGFLVKADSESRPGPFTYGRNHVDGANMLAEALKPYGGLVIWRCFVYNCFQDWRDRTTDRAKAAYDHFKPLDGQFEDNVILQIKNGPIDFQVQEPVSPLFGTMPATNQMLELQITQEYTGQARHVCYLVPQWKEILAFDTYAQGEGSEVAKIVSGSLYGRKLGGVAAVSNIGDDRNWTGHILAQANLYGYGRLVWNCNLSAEQIAREWIALTFGSGSTQRTEVILNLLMTSWLTYEQYTAPLGVGWMVNPHHHYGPNVDGYEYSRWGTYHFADRDGIGVDRTVKSGTGYTAQYREPNASRYESLETCPDELLLFFHHIPYTHRQHSGKTVIQHIYDTRFAGAEQAQQFLDAWLTLEGQMDEEAFENGRSRLLEQAEHAREWRDQINTYFYRKSGIPDEQGRTIY

SEQ ID NO: 29943 - protein, 540 aa, Kitasatospora setae
  strain ATCC 33774 / DSM 43861 / JCM 3304 / KCC A-0304 / NBRC 14216 / KM-6054 Streptomyces setae
MAGPVRRSFRALLAGVLGVTALAGLTLGGGGTATADAAGAPLPAHVFAPYFDVRSGDSPSVVAAQSGNRFLTLGPIRTEAKGSCTPYWNGDTSAPAFWVDRMPKYSQEVDGLQARGGGVVLSFGGYAAGGAGTDLADSCTDVEAIAAAFRKVILAYDAERIDLAVEGRSLTDSGGVDRRNRAVRLTEDWAASVGRDVQFSYTLPATPAGLTPGGLAVLQNALCHGVRVHVVNLLTFDYRDGPRHDMAADTRTAAQCLHEQLRQLYPARTDAQLWGAVGITEMIGVDHYGPEETFSTADAAAVAAWAADRGVGTLSFRALQRDNGGCPGTAGSDSCSGTAQGPWQFSHAFQPFTDPPPVLPSPSSPGPFPSVTDEGPSFLMSLDSHSGSVVAGSSVTTRVTAAVNHATVEYVTVGTAGAPAGVTASANPSMVLTSYPNNPIGTTATLTLTTTAATVPGTYRLLVTGRGNDFHAETAYTLTVTSPAPPEPCAAAAWSPALAYTGGETVSWAGHNWQAAWWSVAEAPGTTGEWGPWKDLGAHY

SEQ ID NO: 29944 - protein, 891 aa, Kitasatospora setae
  strain ATCC 33774 / DSM 43861 / JCM 3304 / KCC A-0304 / NBRC 14216 / KM-6054 Streptomyces setae
MRLRISLPTLAAGLVAGCTVAATLLPVTAAGAAPAGQNAKPSAAASGQNAPASAVDPKAPGGAVPKPLGPIVDAAPDTLTPVAAPLPPALLVQSQMGQPKGTTVQTTPRPAKQNAGKGLLAKSGGTSGGSPLAGAPGAEAGAAGAQAAAAQTCAYTDFGSRSGADLVNFVKGSTNTCVNTLYNVTGTDAGAIFKQANMVTVANAFKDLAAGYDGTNASGILQLVQFLRAGYYVQSYYPSQVGSYDGTLTAATKAGLDAFFAGTRWKDVTTANGVVLYDVLVLTDSANIQAKYLDVYKQVLNGYDNSYNATPKMVNAVNSVLFAPLWRGNWNTDFVNAVSADTSLVTTLGNFALNHRDLMGTSNAFLDVNAGNDISRIAGSSTNAENAAKPLIKQLLDTTAILGSTGPLYVHVAYNANYYDKGQCSYYGTCDLPKKLADTVLPNVLVCDNKTLRAQALTVAQLQPVCDSLRGEDTFFHNLVKDNGPVPNQYGKTVVMPVFASAADYQTYSWAIYGNSTDNGGQTVMDVTDPNNQPVCVMYQKSWNDDFPGNVWNLNHEYTHYLDNIYDMSGNFASETSVPDIWWIEGVAEYQSYTYRGVTDTQAMTEAAKHTYKLSTIFQNTYNNSDSTRVYPWGYLAVRYMFEKHPADVYNMLGHFRTGDYQGGYAVYNGLGTSYDADFDAWLDQCANGACFATGPTALFNQSVNGATVTLTDRSVVTNSPAQITGWHWTFGDGGTSEERNPSHTYAKAGTYTVALTVTDANGRTTATPSSVTTTVDASATLPTCADQRTDAMGQNCQRTGRARAAGDTDYMYIYLPAGTSTLKVTANGGTGTAYLYYNEDTWASPSAFTASSTTQGTAQTITVNNPTAGYRYLSLYAVTDFANVTISTQF

SEQ ID NO: 29945 - protein, 294 aa, Kitasatospora setae
  strain ATCC 33774 / DSM 43861 / JCM 3304 / KCC A-0304 / NBRC 14216 / KM-6054 Streptomyces setae
MSTPHNPLDGLSELADRKISRKGLLKAAAAAAAAPVLVGTGVALARDAVAADAPAPLPLTPECTDGHTTIEQIEGPYFKPGSPLRTSLVTSGTQGVPLTVSGFVFGRNCLPIAGALLDFWQADTNGTYDNSGYTFRGHQFSGANGSYSLTTIVPGLYPGRTRHIHVKVQAPNQPILTTQLYFPNEPRNATDTIYDPALLMTVRQVGNGREASFDFVLNVNGTGTPSPSPSQTQGSPTPSPSPSQTGGTTTWKVGATYKAGDVVTYNGVTYVCIQGHVAYAGWEPPNVPALWQRR

SEQ ID NO: 29946 - protein, 827 aa, Kitasatospora setae
  strain ATCC 33774 / DSM 43861 / JCM 3304 / KCC A-0304 / NBRC 14216 / KM-6054 Streptomyces setae
MGVLDGIGSFVGSVVDAGTDLVGGTLDAIGLDDWGHAVEKWGDGIADDLGAAVGERNLGETDDPAELVHGDLKKLGENIGHLRKFAAAFESTGEGLARMDSAHWQGKAADAFRSRFGDHPPKWSVTGRACADAANALAGLAGTVEWAQGQARQAIDLYKRAQQATEESKDQYKRQVDSYNQAVHAYNSAVQHGESPAQPAKPGDFADAGADGRAEAARTLLEARRRRDEAANTAEAAIRAATQAAPKKAGFWQSLGNDLADAPQIAAVSAEHLVVGAGKGAADLLKFARGVNPMDPYNLSHPAQFMDHMNQVTTGLARTAMHPTELLGALVGTGWGSDPSEAGGKLLFNILSGLGTGGAETAAVAAERVGVGAAENVLKSEVVHAGESAATGAGRRVASGAAEWKPEPQPFTIPPERVPFEVRKPFYETPPATAADPVAAVPREPAGFAPHEPGAGAPQPQPRVHEPVSDAPQPQVHEPVGGSDPFGTRVHDGGQPAAPEPAPVQHEPAPVREEPVQQQQHEPAQHESAQLEGAQHEGAQHEGAQHDAADGGSADGGSADGGASHDGGGASHDGGGASHDGGGASHDGGGASHDGGGADAVAEPAPVQRPSSPYTMRSFEDVQAENLLRDEMRAAEKELSQGAVTFKDGNELSDTMIRDFGAQWRDDVRNFTPEQESAVQAYTHGETDAINGSLRGLQPDSPQIAERVRQLDQAIAAHPVPQDVMVARGMDLKHLDFNDPQDLVGRVVKEDGYMSTSPGDKVPAAFDGKEALVHMRVPAGTEGLWVGDVGVFSDAERELLLQRGLNWRIDKVVKVDGKVHIYGEVIP

SEQ ID NO: 29947 - protein, 786 aa, Kitasatospora setae
  strain ATCC 33774 / DSM 43861 / JCM 3304 / KCC A-0304 / NBRC 14216 / KM-6054 Streptomyces setae
MRSPRKTLLAAAIAASLALPLLQNAHAVAADPATASTPAATATAAAATAAPTGRTAYDEVDHLAAAPATSAPAPAGGAFTQDAHVPGLPDTAGRPAPTAGETAGATVAGTGTTAAGVRCDLNGLTGLGPRALADFLADPAVTESCLQTLLWRWDARFATTMDAAHVQAVAAKAEQLAAGNDPNLYQLWYFLHAAVYHDFTRDEIDLTTPATTAPVQRAIDAYLAAGRAFEPTAAAGLVMRELANTATAPGIREHNLPLVKRILGQFGPGTKVADSWEWGGAAFSALNISYLGIYNRDQAFRANVAADADYRAAFRAFATAAQLKGTQNSWVARDAMNEYGRFSEISTLTAPITAEIGSLLADTGKTFGETSPQWIKVVGWANTLKVCQQFDVCTSKYEAILFPYTYKYDNGAIEVHTALDKATVDQMYYASKQVKSQFFRVLGTDTPLAGDPNDTLRIQLYPTRAAYEIYHPLLTGMGTENGGVYIERGATFYTYQRTTAESYLTLEELFRHEYVHYLNGRWATPGYFNDPRWYAGSKTTAMDEGTAEFFDGATRDQGVKVRQSLVAALTRDEANGIPRLSVGEVLHASYDDTPAFHFYNYAGTFFEFLWNAHPALLREMYAYQRADDPAGYDAWRTRLSADQNLNREYWAFLDEQIKQGAAKALYVPKTAFTANGYLKYAYPSEVRDAFAKATSNTPECKDNGDWDNKPMRFVCTGRITANLVNSTNPDQVIKDMSGTVDYFLLQRTKGVANNLDDMNCYFGKVDVWPGGQAGTADYTCEGPLRR

SEQ ID NO: 29948 - protein, 216 aa, Kitasatospora setae
  strain ATCC 33774 / DSM 43861 / JCM 3304 / KCC A-0304 / NBRC 14216 / KM-6054 Streptomyces setae
MNRSMTVLAAALGLVLSVGSAAAVPAAAATPAAPSTATAQGYTPAAGLAAKSEDANNKAFYEAVMKSARAKQAANPYLLVVAVTYDASQAPSFRTVISQSAQIWNSSVSNVQLRSGTNADFRYYEGNDSRGSYASTDGHGRGYIFLDYAQNRQYSSLRVIAHETGHVLGLPDHYSGPCSELMSGGGPGTSCTNPYPNTTERSRVNSLWAYGLAAAG

SEQ ID NO: 29949 - protein, 276 aa, Kitasatospora setae
  strain ATCC 33774 / DSM 43861 / JCM 3304 / KCC A-0304 / NBRC 14216 / KM-6054 Streptomyces setae
MTFRNETAAATTTPKRNRVRAAVVGGALLAAPVAGLVTANTASAADVSTWDKVAQCESTGNWSINTGNGFYGGLQFTSSTWAAFGGTAYAPQANQATKAQQIAVAEKVLASQGPGAWPVCSVQAGLTKGGAPAQVDTSSSGSSSTSSKSTSSNSSSSNSSKSTSSNNSTSSKSTSSNSAASDDSAKASRSESRAQAPKAAAQETPKQTWKNKSASATTTNTAKAATTGDGYTVKAGDTLSKIADSLGVDWHTLYSNNSGVVGGNPDLIYPGQVLSV

SEQ ID NO: 29950 - protein, 107 aa, Kitasatospora setae
  strain ATCC 33774 / DSM 43861 / JCM 3304 / KCC A-0304 / NBRC 14216 / KM-6054 Streptomyces setae
MVVGLLLPAAVTATAGTPAAARQAVSDLVWDRLADCESDGDWEADTGNGYYGGIQIWPPTWREAGGQRYADRPDHASRRQQITVGEEILRRQGWRAWGGCAREIGML

SEQ ID NO: 29951 - protein, 680 aa, Kitasatospora setae
  strain ATCC 33774 / DSM 43861 / JCM 3304 / KCC A-0304 / NBRC 14216 / KM-6054 Streptomyces setae
MAPHTRRVLALGTTLSTLTLGLVAFVGVPAAQAATPAHPFPSHTAYKVGVMPSASQATRDAAVTKQYDSWKSNYLVHGCASNEYYVSTKGDGDAPNNGTVSEAQGYGMNIVPLMAGYDPDAQTEFNGLWQLVKNHQDQYGLMQWKLDGSTCKYADSGTPDAATDGDLDIGYGLILADKQWGGYKTDALAWLGKIYAHDVTSDGHLKCEDDGVSTDTRPSDHMLDHLRAFAAYDTAHDWNKVISRTEAIDQSLVSNYSNGHGLLPDFVVGANGTPSPAPANYQESQPDNIVGYNSVRVPWHMGTDALLNGPSTAAFAYNDAKLWSACAKAISGGNPKNVQPHIKLSCANANVSGDTSAEEAGDSVGPSAMAAGDQAWTDAIWNQLATNPFGDHYYGETIKMLVYLVMAGDYWNPAATTTAPANDFSLALSPASGSVSAGASATVTVSTATTSGTAQSVALSASGLPAGASASFSPASVNSDSGSTLTVTTTASTPAGTYPITVKGTAASGTHSATYTLTVTTTAPANDFSLTLSPVSGSVSAGASATAAVSTATTSGTAQSVTLTATGLPAGASASFSPASVNSGSGSTLTVTTTASTPAGTYPITVKGTAASGTHSATYTLTVTTTSTGTCQPAWNPATAYVPNDQVSYNGHNYTALYWSTDVTPGSAIAWNIWQDNGTC

SEQ ID NO: 29952 - protein, 461 aa, Kitasatospora setae
  strain ATCC 33774 / DSM 43861 / JCM 3304 / KCC A-0304 / NBRC 14216 / KM-6054 Streptomyces setae
MAAALPAAALAVVAAGPAHAAGGTFPAHYSAPYLEIDSSTAGDLAADLSASGDKFYTLAFLTPKSGCTPMWERGNDPVGAFKSQIGSLQSAGGNVIISFGGAAGGELAQTCTSVSSLTAAYANIVNTYGVTRLDFDIEGSVLDDTTANARRDQALAALQAQNPNVQIDFTLPVDPGGLPANAMNMLKDAKSKGVKVNLVNIMTMDFGNGQNALNDAESAANGTAPQLASLYGITTAQAFNRLGLTPIAGQNDDNEFFSQANAQTLETFAASKGVQELAFWEVDGYDKALNYAYSKIFQKITGGTTASDFSVAVSPNSGSVKAGSPATVSVSTAVTSGVAESVALSASGLPAGASASFSPASVNSGSGSTLTVTTTASTPAGTYPITVKGTAASGTHSATYTLTVTATSTGTCQPAWNPATAYVPNDQVSYNGHNYTALYWSTDVTPGSAIAWNIWQDNGTC

SEQ ID NO: 29953 - protein, 546 aa, Kitasatospora setae
  strain ATCC 33774 / DSM 43861 / JCM 3304 / KCC A-0304 / NBRC 14216 / KM-6054 Streptomyces setae
MTTPTAVAAPSGGGTATVSAAVTAPAAFTHPGVLLGKSQLDLIRTRVNGGVEPQKSAWSQLLASPYASSSYTPHPRSTVECGSSSNPDYGCSDEREDAIAAYTDALAWYVTGNSSYAKKAIQIMDAWSGTITTHTNTNAPLQTGWAGTVWSESAEIVKYTYSGGWSNSARFDTMLRNVYLPVVIQGAPDKNGNWELIMMDAAVGIAVHLDDATSYNKAMSIFTGRVPAYVYTTSDGSQPAYPPRSSINTTSELVSYWFGQSTFVNGLAQETCRDFGHTGWGLDAISHVAETARLQGTDLWSQLATRMRSTYEFHAGYDNGASVPSSLCGGSVSLGVGPVTEIAYSALHNRLGLSLANTQKYTLAHRPEGTDDHWIAWETLTHGDTGTPAAANDFSLALSPASGSVSAGSPATAAVSTATTSGTAQSVTLTATGLPAGASASFSPASVNSGSGSTLTVTTTASTPAGTYPITVKGTAASGTHSATYTLTVTTTSTGTCQPAWNPATAYVPNDQVSYNGHNYTALYWSTDVTPGSAIAWNIWQDNGTC

SEQ ID NO: 29954 - protein, 427 aa, Kitasatospora setae
  strain ATCC 33774 / DSM 43861 / JCM 3304 / KCC A-0304 / NBRC 14216 / KM-6054 Streptomyces setae
MERALPPHSPATAPARPRRPRRAVAVALSVFGLLAGGVSAVAASGSANAATTDGLGSNWYASAPYLMPEDNSPPDAAAVMDATGQKAFQLAFILAQGNTCSPSWGGTSSIDTDTTMPAVIQTIRNKGGDVSVSVGGYGGTKLGQTCGTPEATAAAYQKVVTKYNLKAIDFDLEEPEYENTAAIHNEIGAARILQQNNPGIYVSITTAGTNAGTGWFGTQMLLEAKSQGFTPNNYSIMPFDGGFNGAAAQTDALVKFNQILQNTFGWNEATAYAHEGVSLMNGRTDAAEYFKQADFQTVLDFATAHKLARYTYWSVNRDRQCPGTVDPGLSGACSSVAQSDWDFTKFTVKFAGATPPTSPSPSPTTSTSTSTPPGTPCAPPWGAGTVYTGGNPVSYKGHNYHAKWWTTNEVPGSTGQWGVWADDGPCV

SEQ ID NO: 29955 - protein, 405 aa, Kitasatospora setae
  strain ATCC 33774 / DSM 43861 / JCM 3304 / KCC A-0304 / NBRC 14216 / KM-6054 Streptomyces setae
MLFTGSGRHRRQSQAEKTAERAIAAAGVAGLGIALPLLTVSGAHAAPSAVWDRVAECESGGNWGSNAGNGLYGGLQINAQRWTDYGGTQYAPLPDGATRSQQIAVAERILATEGPSPWSACADGAGLNTASAPGVVDDNDSASETGSLRGARGIAAVNAAPDGSTAPADGSTAPVFSGLPGYDPVAHVYWYEKNGAWFWTSHQSLYERYLQLTHPQPQPSTPTPPAPTDSATPAPGTPTTPAPDASATPTVPPASPGTPLVPTGPTTTPTPGAPAEGNNGNGNNGNGGNGSGLFPTAPVSPTPDAPTSPTPSTPSASSATTATPSAPATPAPSTAAPTDAAAAATPAGPAAGSAQPYTVGPGDTLASIARTHAVDGGWSELYASNQQVVGGNPDLIHPGQVLDLK

SEQ ID NO: 29956 - protein, 325 aa, Kitasatospora setae
  strain ATCC 33774 / DSM 43861 / JCM 3304 / KCC A-0304 / NBRC 14216 / KM-6054 Streptomyces setae
MSALRAARTAAVLAIAASLLTSTQTLAHAETAPAAVAPLDVLSYNTFLMSTSLYPNWGQAQRAQAIAGADFFQGHDVVVLQEAFDNAASDALAAKASAAYPYRTPVVGRSTSGWDATSGGYSGATPEDGGVLLLSRWPILRKEQYVFKDACGSDRWSNKGFAYAEIDVNGQLTHVVGTHLQSTDPGCASGQAADVRARQLRAVRAFLDAKRIPAGEPVVLAGDLNIDSHGGEYPALLANGGLAPATARTGWANSFDPADNSIAAYRYPGEPKEDLDYVLYRADHARPQQYANTVHRFHSAPWTVSSWGTSYTYTDLSDHYPLLAG

SEQ ID NO: 29957 - protein, 259 aa, Kitasatospora setae
  strain ATCC 33774 / DSM 43861 / JCM 3304 / KCC A-0304 / NBRC 14216 / KM-6054 Streptomyces setae
MIFRNETAATKTATTADQGNRKRNRVRGAIVAGTAVAVLPVAGLVTATSASAADVSTWDKVAQCESTGNWSINSGNGFYGGLQFTSSTWAAFGGTAYAPQANQATKAQQIEIAEKVLASQGPGAWPVCSVQAGLTQGGAAAKVDTSSSSTAASSTNSSNATSGNTSSSTKSAKSATTQTDSASTNTDSSASASADQGRQSWKKSTTTNAGGGSYTVKSGDTLSAIAAANGTSVDALYSANAQTIGASADVIYPGQVLSV

SEQ ID NO: 29958 - protein, 276 aa, Kitasatospora setae
  strain ATCC 33774 / DSM 43861 / JCM 3304 / KCC A-0304 / NBRC 14216 / KM-6054 Streptomyces setae
MQTKRKVTAVVGALVAPLLGLTMTAGTASAHGWVTNPASRQDQCANNVVSCGQIKYEPQSVEGPKGLTSCSAGHAEYAELDNDNLGWKVTTVSSVQTFTWHFTARHSTANWQYYIGNQLIATFPGNNAQPPADLSQTVNFGSFTGRQKVLAVWNVSDTANAFYSCIDVNIGGTGGTTGGTTGGTTGGTTGGTTAGGTTGGTTGGTTGGTTAGGTTTGGTTGGTGSCKTTAWSATAVYNGGETVSYGGHNWRAKWWTQGEQPGSTGQWGVWDDLGAC

SEQ ID NO: 29959 - protein, 292 aa, Kitasatospora setae
  strain ATCC 33774 / DSM 43861 / JCM 3304 / KCC A-0304 / NBRC 14216 / KM-6054 Streptomyces setae
MHPSKHRTARTARTTRAALAILAGVLPLTLAATGAGHAATPAAGGTSAVRAAAVAAVGLDDPAKKEIAMKLVSSAENSSLDWKAQYKYIEDIGDGRGYTGGIIGFCSGTGDMLELVQHYTDLKAGNVLAKYLPALKKVNGTDSHTGLGSAFVNDWKTAAKDTVFQQAQNDERDRVYFNPAVKQAKADGLRALGQFAYYDAIVMHGPGTSADSFGGIRAAALKKAKTPAQGGDEATYIKAFLDARKVVMKQEEAHADTSRVDTEQLVFLNAKNFDLNPPLKWKVYGDPYEINS

SEQ ID NO: 29960 - protein, 397 aa, Kitasatospora setae
  strain ATCC 33774 / DSM 43861 / JCM 3304 / KCC A-0304 / NBRC 14216 / KM-6054 Streptomyces setae
MSHTRNTRTTSRPAHRAGSRRGKVAALLTGALAATGLAVMVPTTSTAATACTTPYSATQVYTGGMSASYNGHNWNAKWWTQGETPTTGGSGVWADQGACGGGTTTSPTPSTSVSTNPSPSSTPKACELSIWVAGTQYTTGTVVKYVPNGQFYVATHDNPGYDPTISTWYWSPTTCSTDTPTPSPSVTTPNPGGFVVSEAQFNQMFPNRNPFYTYSGLVNALSAYPAFAGTGSDTVKKQEAAAFLANINHETGGLVYVVEQNTANYPHYCDTTQPYGCPAGQAAYYGRGPIQLSWNFNYKAAGDALGIDLLNNPNLVQTDAAVAWKTGIWYWMTQNGPGTMTAHNAMVNGKGFGETIRSINGSLECNGGNPAQVQSRVNAYTSFTAILGVPTGSNLSC

SEQ ID NO: 29961 - protein, 451 aa, Kitasatospora setae
  strain ATCC 33774 / DSM 43861 / JCM 3304 / KCC A-0304 / NBRC 14216 / KM-6054 Streptomyces setae
MGEERSFMLPISSKNARRLIATTGVVGIGLTIPCLTAGSASAATVATWDKVAQCESSGNWSINTGNGFYGGLQFTASTWAEFGGTAYASRADLATKEQQIATAEKVLAVQGPGAWPVCSVQAGLTKGGAAPQVDTSGSSGNSSSSSSSSSSNSTGSTQSPSPSQSQSGGTDKSQHSWSQSRHQNQSQPQAQAQPQAEQSTPAATDQSAGTYTVVAGDWLSAIAQSQHVDGGWQKLYDLNRSVLTEGPDMIYPGQQLALGGTATATAQPQQSAPATKSSNGSSYQGSSWKSGRTGGKAGASTATTAAKSATGTATTATTEAKTATATTAVKATGSKAAAIDFALSKLGQAYVYGGTGNGGWDCSGLTQAAFRQAGISLPRVAADQADYATRVSLDSLQPGDLLFWSSNGANSGVYHVALYVGDGKYVEAANPRSGVRTETVANWAPDFAGRV

SEQ ID NO: 29962 - protein, 893 aa, Kitasatospora setae
  strain ATCC 33774 / DSM 43861 / JCM 3304 / KCC A-0304 / NBRC 14216 / KM-6054 Streptomyces setae
MAFASAGRTLSLLLSLCMALGFLGALAPGARAADPAGQKPAKSENSDQALKADRAAKAGKEAPLSSAASELRKDSASNVRSDASKRPPLAAKGEPGGLPGDVPTATTACNASDFTGRTGAALVAQIKASTVDCVNSLFLLKGNDAKAAFNESQMVTVANALRDVSANYAGDNSASAHQIVLYLRAGYYVQWYNADVVGTYGSNLKGAIEGGLDAFFNSAHAQDVTDANGETLGEAVTLIDSSLENARYLNVVKRLLNGYNSSYDASWYMVNAVNNTFTVFWRGHQNSDFLPAVKADPSVLSTLQSFANRNIGRLGTDKDFLVANSGRELGRFLQYADLKPTVSPMVKGLLDQSSITGNTASLWVGLAEMTDSYDKANCAYYGTCDLVNRVKAAVLTVNYTCSDSIDIIAQSLTADQLATACTSLKGQDAYFHNVAKDNGPVADDKNTTIDVVVFHSSSDYQKYAGIIFGISTNNGGMYLEGDPTAAGNQPRFIAYEAEWVRPDFQIWNLNHEYTHFLDGRFDMYGDFDAGLTTPTVWWVEGFAEYVNYGYRGADNTGAIDQAGQHTYPLSTLFDTTYQNADQTRIYSWGYLAVRYMLEQHRSDMDAVLAKYRTGDWAGARTILKTTIGTRYDADFNTWLTACNAGACGKGSGTTPPTTPGGDCTAASPQQIDLGCTRKDASAAAGDYSYFYVWVPAGTANLTVSSSGGTGNADLYYNAATWATTGANTAKSTNSGNTETLTIANPTEGWNYVSLYAAGDQPISGVSITATNGTATTPPGNTGGGECTAADTRQLDKGCVRSNVAATNGNYAYFFVWVPNGTASLKINASGGTGNADLYYNAATWATTGANTAKSTNSGNTETLTIANPTAGWNFVSLYAAGQDFAGTTVSASF

SEQ ID NO: 29963 - protein, 608 aa, Kitasatospora setae
  strain ATCC 33774 / DSM 43861 / JCM 3304 / KCC A-0304 / NBRC 14216 / KM-6054 Streptomyces setae
MLRSVSSAAPARRRPKGWSALAAGTAASLLLGSALALTAGGTAQAAPTNSTGAPATSGGIKVAYFDQWSIYSNAYYLKTMQDTGAAGKLDYIIYDFANIHPTNGTCFEANKAASQNEDDPNAGDGAGDSFADYQKSFGADISVDGVGDTWNQPIVGNFNQLKKLKAKNPNLKVLMSIGGWTYSKYFSDVAASDASRKKFVSSCVDMFIKGNLPVEGGYGGAGTAAGIFDGFDLDWEYPGGNGHTGNHASPNDKQNFTALLAEFRSQLDAQTKTDGRTYGLAAAVGAGQDKIKQVETDKIGQYLTFLDIMTYDMHGGWEAQGPTNHQAPIYTNPNDPMNPVPGGNGKYSVDAAVKAYTVGDPQYGIAGGFPAKKINVGIPFYYRGWTGVSAGTTHGLFQKASAPAPGGTYSGGVAGIKMFKELNGFVDNPSYTYWDDAAKAAYFYDGTTFWSGENAQSIQAKLDYAHCNGLGGSFMFSMYDLGTQTGLFDKTVTATNGSAASCPAAPTGSASPTASASASQSASPSASASASASASASASASASASASASASASTGACAGAPSWSAATVYATSTKVSWKGHYYTNKWWTTNEDPSLSGAWGVWTDNGAC

SEQ ID NO: 29964 - protein, 747 aa, Kitasatospora setae
  strain ATCC 33774 / DSM 43861 / JCM 3304 / KCC A-0304 / NBRC 14216 / KM-6054 Streptomyces setae
MFALAFALVLTIGLFSPQGSAFAAAPTASGTGASDGSSTDPAAHPVPKSPDEPADSRPTPGAERTGGTSAAPQKATPSAPTVKSAKKFGALAADANGCDTSLFGSTTGTALVNTVKSASLDCVGKLYNITGTDAKNTFAEPQMVTVANALRTASANYDGTNSASVAQLVTFLRAGYYVQWYNADTVGAYGSSLQSAVRGALDAFYAAPHAKDVTEANGQILSEAVILIDSAQENARYTGVVKDLLDRYTSGWTGGMWSAVNNTKLVLENGLGDDAFNAALVADPAVGTSIASFVKRNSSMITGGDLATNLGIDLGSFLQQPVLQAQARPLVKDLVNAFPLVGATGPLTMNLAWFTEKKDEGHCSYYGLCDLPTRLAPLVLTVDRVCSPTLHIRAQALSTTELDSTCSSLANEDALFHSVVKDNGPVADDVNTALEVVVYDSSYDYRLYAWSMFDIDVDNGGMYLEGTPSKAGNQARFIAHEAEWLRPAFSIWNLNHEYAHYLDGRFDFYGDYEAGQTNPNIWWIEGFAEYMSYTYRDVRYDDAIAQAAKGTYKLSTLFDTTYENTDSTRTYNWGYLATRYMLQSHPQDVAAYLGKTRTGDYTGARAVITGIGTSYDADFAKYLTACGAGDCGTLQPAAPLCTNQDTRWYEQNCRRDGVAATTGNYSYNFLNLPAGVKQLTITTSGGTGNADLYWNASNWATTGASTAKSTNTGNGETLTITNPPAGWVYFSLYAQDGFSGVTVTTQY

SEQ ID NO: 29965 - protein, 834 aa, Kitasatospora setae
  strain ATCC 33774 / DSM 43861 / JCM 3304 / KCC A-0304 / NBRC 14216 / KM-6054 Streptomyces setae
MLIRNKAEQRPTAAGRHYKGRKVAFAATAAAGLAGLLMGTLGVAPSAAAVDNQACRPDGMYTTPGVDVPYCNVYDTSGREQMGADHQRRVIGYFTSWRTGKDGTPAYLVNNIPWDKVTHLNYAFAHVASDNTLSVGTDGPNNASTGMTFPGVAGAEMDPAYSYKGHFNLLSKFKKQYPNVKTMVSVGGWAETGGYFDDSGSRVNSGGFYSMTVNADGSVNQAGINTFADSAVTFIKKYGFNGVDLDYEYPTSMKDAGNPLDYTLSNAKRASLMKGYAALMKTMREKLDRASAADGKYYLLSVAAPSSGYLLRGMETFQVTQYLDYVNIMSYDLHGAWNKYVGPNASLYDDGKDAELAAANVYGTSQYGGIGYLNTDWAVHYFRGAMPAGRINLGVPYYTRGFQNVQGGTNGLWGTSSTTNCPAGSGLTTCGDGAVGIDNIWHDLDTNGKESPAGSNPMWHAKNLEAGVVPDYLSKYGVTDTALKGTYTRNYSSALVAPWLWNADKKVFLSTEDDQSIGAKADYVVNQGVGGAMIWELAGDYKWDATANGGKGEYVQGNTMTSLLYDKFKSASAYGATRSTIALPQQTLPIDVSFTDFALGDNNYPINPKIHIVNNSTTTLPGGTEFQFDYSVSAPSNAADQSGFGSKVIRADHTGSNVGGLKGTYNRVSLKLPTWQTLAPGASVDVAFVYYLPVSTPSNWTVNVAGTLYGITGDYTRGTTASTSSPSPSASVSASASASQSASPSASASASASASQSASPSASASASQSASPSASASVTAGTCSGAPSWSAGTTYAAVTKVSWKGHYYQNKWWTAGEDPSLSGAWGVWTDLGAC

SEQ ID NO: 29966 - protein, 418 aa, Kitasatospora setae
  strain ATCC 33774 / DSM 43861 / JCM 3304 / KCC A-0304 / NBRC 14216 / KM-6054 Streptomyces setae
MPSSRRTRLLGTFALTAGLTASSCVLATVDASAASVANWDRVAQCESSGNWSINTNNGLYGGLQFDLPTWRAYGGTQYAAYPHQATKQQQILIAEKVLNGPQGAGAWPQCGGPLVGDHTNPYPSAPPTPPASSGTGSGGVAASATDTTVHLEIIGSDGAMYTNDGNYTTGAWSTWTKLDNANLKSVSAAAIGGVSHVFAVANDGRVYTRDANYTTGTWSDWAEVPGGAGGAKAVMATATGNTVHLEIIGSDGAMYTNDANYTTGTWGVWTRMDGANLKSLAGVAIGNVSHVFAVSEDGRVYSRDADYGAGTWTGWAEVPGGASGAKGITATATGTTAHLEIIGSDGAMYNNDANYTTGTWSTWTKMDSANLKSLASVAIGNVNHVFAVAADGHVYTRDANYTTGTWSNWAEVPGGASA

SEQ ID NO: 29967 - protein, 433 aa, Kitasatospora setae
  strain ATCC 33774 / DSM 43861 / JCM 3304 / KCC A-0304 / NBRC 14216 / KM-6054 Streptomyces setae
MSFIGSKRGTAVAVAVAGGLLAVAIGGLSPATAAGTNLALNKPVTVSSTEASGYSGAKAVDGSGTTRWSSTEGVDNQWIRIDLGAGTAVDRVVLKWEAAYAKAYRVELSDDGSTWRQVYSTSSGDGGTDDLAVSGTGRYLRVYGTQRGTAYGYSLWEVEAYGTGGGSTASPSPTASASASASPTASPSPSASSSTTPPTGGVNLDDPAKKEIAMKLVSSAENSSLDWRAQFSYIEDIKDGRGYTAGIIGFCSGTGDMLDLVEAYTAKKPGNVLASYLPALRSVNGTDSHQGLDPGFPAAWKQAATDPVFTQTQESERDRVYFNPAVAQAKKDGLRALGQFAYYDAAVMHGPDGLASIRSAALAKAKPPAQGGNETTWLNAFLDAREAEMRKEAAHSDTTRVSTEQRKFLNEGNFDLHTPLTWSVYGEPYSITS

SEQ ID NO: 29968 - protein, 277 aa, Kitasatospora setae
  strain ATCC 33774 / DSM 43861 / JCM 3304 / KCC A-0304 / NBRC 14216 / KM-6054 Streptomyces setae
MRPARPLARRTLLAGAAAAAALVLGLNLVPASAAAGGGLTTDQRRRADQLISVFENGTTVIQYGYAENINDGRGVTAGRAGFTTNDGDALKVVRAYTEQVPDNPLAAFVPELERLAAAGSGDTSGLPEADYVTAWKRAADDPAFRRVQDAQVDERYFAPAMADADRLGLTTALARAELFDASVQHGNGSEYDALPALIARTSAKAGTPAAAGEDAWLDAFFDVRIDDLTHPANSATQAEWSQSVDRVEALRRIARTGNRNLDGPFTVTAFGATHTIS

SEQ ID NO: 29969 - protein, 200 aa, Kitasatospora setae
  strain ATCC 33774 / DSM 43861 / JCM 3304 / KCC A-0304 / NBRC 14216 / KM-6054 Streptomyces setae
MSVRLRTRRSAAVLLGAALLAAATACGPTDNSVATSPKSTAAAPAAGGGGGSAPAADAKAPAVAKTGDTIALKGTEKGNTADVTVVKVVDNAKGADEYTRPAAGKRYVTVQFRIKATGTAAYSDSPHNSAKLVDSQGQNFEATIAETDAGPEFPVPLAIAPGDSALGCVTFEVPADAKLDKAQFTLDSGFAQQAGQWKLS

SEQ ID NO: 29970 - protein, 246 aa, Kitasatospora setae
  strain ATCC 33774 / DSM 43861 / JCM 3304 / KCC A-0304 / NBRC 14216 / KM-6054 Streptomyces setae
MLFSNAARHRRSTKAEKVIAAAGVASVGLALPLLAATGAAAAPVDTWDRVAQCESGGNWNTNTGNGFYGGLQFTSSTWRAYGGAQYAARADQASRAQQIAVAERVLAGQGPGAWPVCSKRAGLAKGGAPADVSDDAASRSGERTPAPQPPKGQPPTKPAKPGGKPTATPTRPAEQPRSTDSQPAAAPQAAPQDATAGGYTVREGDTLSGIAVARQVAGGWERIYRDNHQLIGADPDLIVPGQVLAL

SEQ ID NO: 29971 - protein, 426 aa, Kitasatospora setae
  strain ATCC 33774 / DSM 43861 / JCM 3304 / KCC A-0304 / NBRC 14216 / KM-6054 Streptomyces setae
MPSIDVVVAREILDSRGNPTVEVEVGLDDGSTGRAAVPSGASTGAFEALELRDGDKNRYFGKGVEKAVLAVIEQIGPELVGYDATEQRLIDQAMLDLDATPDKSSLGANAILGVSLAVAHAASEASDLPLFRYLGGPNAHVLPVPMMNILNGGSHADSNVDIQEFMIAPIGAESFSEAVRWGVEVYHTLKGVLKERGLSTGLGDEGGFAPNLDSNREALDLITEAIKKAGYTPGKDVALALDVAASEFFKDGAYQFEGKALSSADLIAYYAELVADYPLVSIEDPLDESDWDGWKAITDAIGDKVQLVGDDLFVTNPERLRKGIETGTANALLVKVNQIGSLTETLDAVELAQRNGYRCMMSHRSGETEDVTIADLAVATNCGQIKTGAPARSERVAKYNQLLRIEEILDDAAEYAGRSSFPRFKG

SEQ ID NO: 29972 - protein, 446 aa, Kitasatospora setae
  strain ATCC 33774 / DSM 43861 / JCM 3304 / KCC A-0304 / NBRC 14216 / KM-6054 Streptomyces setae
MPRIHSSASRLLGVLAVLALALGLNLQAAPRAGAASLTQVTNFGTNPTGLLMHLYVPASVRPDPPILLALHGCQGSGPYLYSSTDFGRLADQYGFLVVYPSTSPAGSCWDVSSDQALTRGGGSDPVGLMSMVTYAEQHYGGNPNAVYVTGESSGGMMTNVMLADYPDVFKAGAAFMGVPYHCFATGTVRGWNSACAQGQVSMTAQQWGALARGAYPGYTGPRPRVQLWHGTADTILSHHDLGEEVKQWTDVLGVGQTPSSADTPAANWNRTRYADAAGTVRVEAYSIVGAGHELPVQGAGMAANAVHFMGLDAAPAPAGGPLRAVAAGKCLTDPGSAAGSQQQIAGCTGAAGQTWTRTADGRLTVTVGGATRCLDASAKGTANGTKVITWSCNGQPNQQWQVNADGTVTGVQSGLCLDVAGLGTADGTPVQLWGCSGGTNQQWKLG

SEQ ID NO: 29973 - protein, 209 aa, Kitasatospora setae
  strain ATCC 33774 / DSM 43861 / JCM 3304 / KCC A-0304 / NBRC 14216 / KM-6054 Streptomyces setae
MAGPVRAPLRALLAGAVTTATAVAGVALAGAGTVHAAGAPSPSPSPSASSVLSPAIQVQVNPSSGTLAPGSSATASVGTAIINNGSYTSIALTVSGAPAGVSASVNPSSVSGSSSAALSVSTGSAVVPGTYTLTVNGVLTGTSATSSATYTLTVTAPACPAAPWVGAQVYTGGATVSWKGHQWSAKWWTLGEEPGTTGQWGVWQDLGSC

SEQ ID NO: 29974 - protein, 1060 aa, Kitasatospora setae
  strain ATCC 33774 / DSM 43861 / JCM 3304 / KCC A-0304 / NBRC 14216 / KM-6054 Streptomyces setae
MLTAGTTLAVLGGMLGGFAGQANAAPLPAPPAPTPLAAAVSAADLAASAGLDSLAKGPDESYERRNVTQFLNGLYSVSYERSYKGLPVVGGDAVVLADGQGKVRGVQNAATGPVGVPTKAKVSAAAAEKAARARLAKVDSAEAPRLVVRVKDGTSRLAWESVLTGTTENRPSHLHVFVDAVTGEVADSYDDVKAGTINSKWNGPAGLTINTSGSAGSYSLRDATRPGLQCSDYSTGQVFSKSTDSWGTGAATSKETGCADAMFAAQKEWDMLRDWLGRNGHNGNGGSWPVKVGLNDVNAYWDGSTISIGHSQANEWIASIDVVGHEFGHGLDQFTPGGANNEAGLGEATGDIMGALTEAYANEPSPYDSPDYTVGEMINLVGSGPIRVMYNPSQVSGNPNCYSSSIPNTEEHAAAGPLNHWFYLLAEGSNPGGGKPTSPTCNSSSVTGIGIRDAGRVFYGGMLLKTSGMTYKKYRTATLTAAKNLDASCTFFNRTKAAWDAVSVPAQAGDPTCTSSPTSDYSLALNPSSGSVQAGSSTSATVSTAVTAGSAANVSLTVTGAPSGTTATVSPSSVQSGGSATLNVNVGANTAAGTYTLTVTGTGPATHTAQYQLTVTGGGGNPGGSAPDINVANVQAHLSQLYTIAQQNGGNRRAGTAGYTQSLAYVKGKLQAAGYTVTEQTCTSCTYTSNNLIADWPGGPSDQVTMFGAHLDSVSAGPGINDNGSGSATLLENALVLAQQNPTMTRHVRFAWWAGEEQGLQGSQYYVGQLSSTQRSAIKGYYNFDMVGSPNAGYFINNVNSATAAPLKAYWDSLNLQPEENVEGQGRSDDYSFQQGGIPTSGYAAGASATKSSSQAAKWGGNAGASYDSCYHSACDTTSNINATVLNRNADGVAYAIWKTSVGGTTVPTDDFTLAVNPSTGTVQAGSAASATVSTGTSSGNAQSVSLSASGAPSGTSVSFSPSSVTSGGSSTLTVSTSSSTPAGTYTLTITGAGTAATHTTSYTLVVNGGGTGGGTWAAGVAYNAGDVVTYNGVSYKCLQAHTSQSTWTPDVVPALWQRL

SEQ ID NO: 29975 - protein, 1176 aa, Lysinibacillus sphaericus
  Bacillus sphaericus
MAKQNKGRKFFAASATAALVASAIVPVASAAQLNDFNKISGYAKEAVQSLVDAGVIQGDANGNFNPLKTISRAEAATIFTNALELEAEGDVNFKDVKADAWYYDAIAATVENGIFEGVSATEFAPNKQLTRSEAAKILVDAFELEGEGDLSEFADASTVKPWAKSYLEIAVANGVIKGSEANGKTNLNPNAPITRQDFAVVFSRTIENVDATPKVDKIEVVDAKTLNVTLSDGTKETVTLEKALEPNKETEVTFKIKDVEYKAKVTYVVTTATAVKSVSATNLKEVVVEFDGTVDKETAEDAANYALKSGKTIKSVSLAADNKTATVTLTDKLNNNKADAISISNVKAGDKEINVKNVEFTAVDNKIPEVTEVKSLGTKAVKVTLSEPVENLSSTNFTLDGKAYFGNVVMGAGNKTVILTPYSSSALSVGDHKLTVSGAKDFAGFVSLNSTHEFKVVEDKEAPTVTEATATLETVTLTFSEDIDMDTVKASNVYWKSGDSKKEASEFERIADNKYKFVFKGSEKTLPTGKVDVYVEDIKDYSDNKIAKDTKVTVTPEIDQTRPEVRKVTALDEKTIKVTFSKTVDGESAIKTGNYTVKDKDDKVVSVDKVTVDSKDSKSVIIDLYSKVSVGENTITIKNVKDATKLNNTMLDYTGKFTRSDKEGPDYEHVINADAKAKKVVLKFDKKMDAASLADYSNYLVKINDTLQTLSEDVATLSVSNDATVVTITFAETIKGDDVVFASGKAISGSGKVNVNELQVMGVKDTSGNVHKKFNGSENKITLSSTSTPLKLAKIDKDYDAKYTAELVDRKTVKVKFSTVINSAAANAFTSESHKIDSIQVNGTSTVTVKFKDEINTNASDLDLKVNLSKLVDIAGNESTNNTPIAIKAGINLLDSVAPVVVGEPVVDKETITFTFSENLTSVSIGEVLSTDFTVTRVSDNKDLAIKDYSVAIANNNQVVITLSDNREVATAYKVTAKNAKLITDDNGDKKNAIADFTKTTATKVEASGTLSLDAAKTNLNNEITKAKDAKATGTEGTAATNQIVGSKDALQVAIDVAELVKNDTAATLQQLTDAKTDLTAAITAYNAAKVEDISSLLVAPDLVLGTTDNGTITGFVAGTGETLKVTSDSAANVEVTDPTGLAVTAKAKGEANILVQVLKGDKVIKTGTVKVTVSE

SEQ ID NO: 29976 - protein, 344 aa, Neurospora crassa
MKSSLLVVLTAGLAVRDAIAHAIFQQLWVDGVDYGSTCNRLPTSNSPVTNVGSRDVVCNAGTRGVSGKCPVKAGGTVTVEMHQQPGDRSCKSEAIGGAHWGPVQIYLSKVSDASTADGSSGGWFKIFSDAWSKKSGGRVGDDDNWGTRDLNACCGRMDVLIPKDLPSGDYLLRAEALALHTAGQSGGAQFYISCYQITVSGGGSANYATVKFPGAYRASDPGIQINIHAVVSNYVAPGPAVVAGGVTKQAGSGCIGCESTCKVGSSPSAVAPGGKPASGGSDGNAPEVAEPSGGEGSPSAPGACEVAAYGQCGGDQYSGCTQCASGYTCKAVSPPYYSQCAPTS

SEQ ID NO: 29977 - protein, 390 aa, Neurospora crassa
MKATILASTFAAGALAQSGAWGQCGGNGWSGATSCISGYACNYVNDWYSQCQPGTAAPTTTAAATTLVTSTKTAPPASTTTATASGKFKWFGVNEAGGEFGDGIFPGRWGTEFTFPDTNTIQTLRSQGYNIFRVGFAMERLVPNTLTSSFDNGYLTNLTQVVNSVTNSGAYIVLDPHNYGRYYGKIITDTDAFKTFWQNVAAKFASNSKVIFDTNNEYNTMDQTLVLNLNQAAIDGIRAAGATSQYIFVEGNQWTGAWSWNVTNTNLAALTDPENKIVYEMHQYLDSDSSGTSTACVSSEIGVQRIVGATAWLRANGKKGVLGEFAGGANSVCKAAVTGLLEHLKANTDVWEGALWWAAGPWWGDYMYSFEPPSGTGYTYYNSLLKTYTP

SEQ ID NO: 29978 - protein, 276 aa, Neurospora crassa
MALAARCSLRILRKLLRPRSSRLAKAPAPVPTPSSSSIVVFAPPPAPETTSSTVIIVPVSSSTQQPAPTTAPAVVAAPPATTSTMQEHATTKVDSPAAPSGSDYASTLLYHHNIHRSNHSAGAMTWGETYANYAQQAAASCVFQHDLTPGGGGYGQNIAMWGSSDKQTVQNVGAVKAGAQATTNMWYNGELSLWPASDYGKANPDMSNFEGWGHFSQLVWKESKELGCYTQFCPQGTMSSQMDVWYTVCNYYPAGNMGGEYGTNVSPPLNEALVVA

SEQ ID NO: 29979 - protein, 709 aa, Neurospora crassa
MAFSQSQPIGVLTGVSSGISSSNILRLADENGPEPPKDSTVLLPTMTTIQNWSRNCRDRWNGGDNLIDYVYGLSMFPHTNNMYRNSNRLVTIMIDILIIGAGPSGLCAAKTFLQHNPTSNIVILDSHSTVGGVWSKERLYPTLRTNNLYPTMDFSDFPMKDVGIGRPGHHITGEEMHAYLTAYAHHFDLMKRIRFNTRAVRVHQVQEEVTLNSDASCWKVEVEVDVHELGNPTTTVTLETNKLVMATGILGVPNMPSLKGSETFDAPLLHSSALGPRYQDVLQNPHINRVAVLGGSKSAYDTVYLAATTAHKVDWIIRKSGRGPSWVFPSHTKIGPFKAWREKLVTRRIFTFMSPCVLPDHSGKHISWIRDFLHTNKVGKAITKSFWKILHADTIRDCRYREGKDNKNFGVLEPEHSPFWYGTSSGTLNYEQDFKALVTSGQVTIHRQDISHLSPHAIHFLAADDAGKETLAVDALICATGYAATPPVDFFPPELHFQLGIPTTLDSLSDEEKAIWATYDQEADDLITKQFPQLIPLPPPPKSKSKESQDTKTYTPWRLHRGIAPPGPPTLTTARSIVFLSMHSNITNIPRIELQCLWSLAYFHDKLIKVSNSQVHKDTALFQRWCQLRSPLGHGRQYPDLNFDQLPYWDWLVADLGLKVRRKKSVWKELVSPYGSEDYRGLVEEWIEKYGIHKGEGSEQERREGEKRL

SEQ ID NO: 29980 - protein, 314 aa, Neurospora crassa
MRLHTITNLSTTLFTIFTILTFNHVLPVQATPQQQPSKASIFHVRHVDNLSLNTHHPKPTPPAELLPLQQHAKEPITISTITIIITATATVATPSNTPASSSVPSSFLNPALFTSALLNSTNFYRAQHNASAVIYNDTLSSFASHYLDKLGLPFSSSSSSSSLVSQSKSKSKSKSFSSTTTTTKCELTHSQGPYGENLALGCSDVQSCVEMWGNERARYDFGRAKFGEDTGHFTQLVWKDTTDVGCAARWCQGWNAGRGGWYLVCEYWPRGNVVGEFGSMVQRRVEGNGGGSRVRAEWRVMVGVVVVGGWMVFG

SEQ ID NO: 29981 - protein, 293 aa, Neurospora crassa
MVAFSSILLAASTAISGVFALPGELPGQGSLFKRQTYTSSATGTHNGYYFSFWTDGQGSVRYTNEAGGQYTATWSGNGNWVGGKGWMPGTDRTINYTGTYSPNGNSYLAVYGWTRNPLIEYYVVENFGTYNPSTGATRLGSVTSDGGVYDIYRTQRVNQPSIDGTATFYQYWSVRQQKRTGGSVNMKNHFDAWTRSGLTLGTHNYQIVATEGYFSSGSSTINVGASGGSGGGGGGTTPENPGTTTTPTNPGNGGGGSCAAKWGQCGGQGWSGATCCQSGSTCQAANQWYSQCV

SEQ ID NO: 29982 - protein, 484 aa, Neurospora crassa
MAAKKLLLAAALTASALAAPVLEDRQNCGSAWSQCGGIGWSGATCCSSGNSCVEINSYYSQCLPGAQVTTTAGASSTSPTSTSKVSSTTSKVTSSSAAQPITTTTAPSVPTTTIAGGASSTASFTGNPFLGVQGWANSYYSSEIYNHAIPSMTGSLAAQASAVAKVPTFQWLDRNVTVDTLMKSTLEEIRAANKAGANPPYAAHFVVYDLPDRDCAAAASNGEFSIANGGVANYKTYINAIRKLLIEYSDIRTILVIEPDSLANLVTNTNVAKCANAASAYRECTNYAITQLDLPHVAQYLDAGHGGWLGWPANIQPAATLFADIYKAAGKPKSVRGLVTNVSNYNGWSLSSAPSYTTPNPNYDEKKYIEAFSPLLNAAGFPAQFIVDTGRSGKQPTGQIEQGDWCNAIGTGFGVRPTTNTGSSLADAFVWVKPGGESDGTSDTSATRYDYHCGLSDALKPAPEAGQWFQAYFEQLLKNANPAF

SEQ ID NO: 29983 - protein, 300 aa, Neurospora crassa
MWPSPKAAYLLLLARSALVGASPVELEERQSCPSIHVFGARETTVSPGFGTAGVVVNLILQAYPGATSEAIVYPACGGQSSCGGVQYGDSARQGTNAVATAVNSLNARCPDTQIVLVGYSQGGQIMDNAVCGGPDSGAGITTSTPGINASALNQVKAVIMMGNPRYRAGLSYNVGTCTAYGFDPRPAGYTCASASKLQNYCDSPDPYCCTGNDANTHQGYGSKYGQQALAFVKSKLSSGGGGGGGSTPTTPSNPSTPTNPSTGNCAAKWGQCGGQGWTGATCCQSGSTCQAANQWYSQCI

SEQ ID NO: 29984 - protein, 293 aa, Neurospora crassa
MRSSTILQTGLVAALPFAVQAASGSGQSTRYWDCCKPSCSWSGKAPVNRPVLACDANNNPLSDASVKSGCDGGSAYTCANNSPWAVNDQLSYGFAATKLSGGTESSWCCACYALTFTSGPVAGKTLVVQSTSTGGDLGSNHFDINMPGGGVGLFDGCKRQFGGLPGAQYGGISSRSQCDSFPAALKPGCQWRFDWFQNADNPNFTFKQVQCPSELTSRTGCKRNDDSQFPVFTPPSGGGSNPSTPTTPPSSGGGSGCTADKYAQCGGSGWSGCTNCPSGSTCKTINDYYHQCA

SEQ ID NO: 29985 - protein, 653 aa, Neurospora crassa
  strain ATCC 24698 / 74-OR23-1A / CBS 708.71 / DSM 1257 / FGSC 987
MHLPSSLLIAAPLLANVSAEPIRIPQRDVSVVSTSQQLAVRALPDSPSGGYAPAVVDCPKTKPTLRKAVDLSNEEKNWLSIRRKNTIQPMRDLLKRANITGFDSETFMNEAANNISQLPNVAIAISGGGYRALMNGAGFVAAADNRIQNTTGAGGIGGLLQSSTYLAGLSGGGWLVGSLFSNNFSSIETLLSENKVWDFENSIFKGPKEAGLSTVNRIQYWSEVAKEVAKKKDAGFETSITDYWGRALSYQLIGADMGGPAYTFSSIAQTDNFQKAETPFPILVADGRAPGDTIISLNATNYEFNPFETGSWDPTVYGFAPTKYLGANFSNGVIPSGGKCVEGLDQAGFVMGTSSTLFNQFLLANISSYDGVPDVLIEAVTSVLKEIGAKRDDVSQIIPNPFLDWNNRTNPNADTLELDLVDGGEDLQNIPLNPLTQPVRAVDVIFAVDSSADVTNWPNGTALRATYERTFGSISNGTLFPSIPDDWTFINLGLNNRPSFFGCDVKNFTLNANQKVPPLIVYVPNAPYTALSNVSTFDPSYTMSQRNDIIGNGWNSATQGNGTLDSEWPTCVACAVISRSLDRLGRQTPAACKTCFERYCWNGTVNSKDTGVYMPEFKIADAHALDSGAVAIGKMVNVWSSVVVGVVAATLLL

SEQ ID NO: 29986 - protein, 108 aa, Neurospora crassa
  strain ATCC 24698 / 74-OR23-1A / CBS 708.71 / DSM 1257 / FGSC 987
MGFSAGDSKKGANLFKTRCAQCHTLEEGGGNKIGPALHGLFGRKTGSVDGYAYTDANKQKGITWDENTLFEYLENPKKYIPGTKMAFGGLKKDKDRNDIITFMKEATA

SEQ ID NO: 29987 - protein, 619 aa, Neurospora crassa
  strain ATCC 24698 / 74-OR23-1A / CBS 708.71 / DSM 1257 / FGSC 987
MKFLGIAALVAGLLAPSLVLGAPAPGTEGVNLLTPVDKRQDSQAERYGGGGGGGCNSPTNRQCWSPGFNINTDYELGTPNTGKTRRYKLTLTETDNWIGPDGVIKDKVMMVNDKIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLSLVNHSMTIISADLVPVQPYKVDSLFLGVGQRYDVIIDANQAVGNYWFNVTFGGSKLCGDSDNHYPAAIFRYQGAPKALPTNQGVAPVDHQCLDLNDLKPVLQRSLNTNSIALNTGNTIPITLDGFVWRVNGTAININWNKPVLEYVLTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 29988 - protein, 283 aa, Neurospora crassa
  strain ATCC 24698 / 74-OR23-1A / CBS 708.71 / DSM 1257 / FGSC 987
MAVPAFSDIAKSANDLLNKDFYHLAAGTIEVKSNTPNNVAFKVTGKSTHDKVTSGALEGKFTDKPNGLTVTQTWNTANALETKVEMADNLAKGLKAEGIFSFLPATNARGAKFNLHFKQSNFHGRAFFDLLKGPTANIDAIVGHEGFLAGASAGYDVQKAAITGYSAAVGYHAPTYSAAITATDNLSVFSASYYHKVNSQVEAGSKATWNSKTGNTVGLEVATKYRIDPVSFVKGKINDRGVAAIAYNVLLREGVTLGVGASFDTQKLDQATHKVGTSFTFES

SEQ ID NO: 29989 - protein, 624 aa, Neurospora crassa
  strain ATCC 24698 / 74-OR23-1A / CBS 708.71 / DSM 1257 / FGSC 987
MAPTIPPPSVPIPAATPVTVPADSSIWDRVSNWVSEHKAVVYTIAGVSVVITTAGVVYYLRKGSEQKESGPKLSKKERRKRKQAEKGEAEKASTSKTEEAAPTQPKAAAVESADELPEIDEESVVRLSEDERKAYAAKLKELGNKAYGSKDFNKAIDLYSKAIICKPDPVYYSNRAACHNALAQWEQVVADTTAALKLDPHYVKALNRRANAYDQLSRYRHALLDFTASCIIDGFRNEQSAQAVERLLKKFAENKAKEILETKPPKLPSSTFVGNYLQSFRSKPRPEGLEDSVELSEETGLGQLQLGLKHLESKTGTGYEEGSAAFKKALDLGELGPHEALAYNLRGTFHCLMGKHEEALADLSKSIELDPAMTQSYIKRASMNLELGHPDKAEEDFNKAIEQNAEDPDIYYHRAQLHFIKGEFAEAAKDYQKSIDLDSDFIFSHIQLGVTQYKMGSIASSMATFRRCMKNFDQTPDVYNYYGELLLDQNKFQEAIEKFDTAIALEKETKPMCMNVLPLINKALALFQWKQDYAEAEQLCEKALIIDPECDIAVATMAQLLLQQGKVVEALKFFERAAELARTEGELVNALSYAEATRTQIQVQENYPELASKLQGMSGGPGMR

SEQ ID NO: 29990 - protein, 349 aa, Neurospora crassa
  strain ATCC 24698 / 74-OR23-1A / CBS 708.71 / DSM 1257 / FGSC 987
MASFSTESPLAMLRDNAIYSSLSDAFNAFQERRKQFGLSNPGTIETIAREVQRDTLLTNYMFSGLRADVTKAFSLAPLFQVSHQFAMGERLNPYAFAALYGTNQIFAQGNLDNEGALSTRFNYRWGDRTITKTQFSIGGGQDMAQFEHEHLGDDFSASLKAINPSFLDGGLTGIFVGDYLQAVTPRLGLGLQAVWQRQGLTQGPDTAISYFARYKAGDWVASAQLQAQGALNTSFWKKLTDRVQAGVDMTLSVAPSQSMMGGLTKEGITTFGAKYDFRMSTFRAQIDSKGKLSCLLEKRLGAAPVTLTFAADVDHVTQQAKLGMSVSIEASDVDLQEQQEGAQSLNIPF

SEQ ID NO: 29991 - protein, 181 aa, Neurospora crassa
  strain ATCC 24698 / 74-OR23-1A / CBS 708.71 / DSM 1257 / FGSC 987
MPSQAVTYTTAAVAAVATGFLAYAVYFDYKRRNDPEFRRQLRRSARRQARQEKEYAELSQQAQRQRIRQMVDEAKEEGFPTTSDEKEAYFLEQVQAGEILGQDPTKAIDASLAFYKALKVYPTPGDLISIYDKTVAKPILDILAEMIAYDPSLKIGTNYTGGVDVAELMREMASAPGVGLD

SEQ ID NO: 29992 - protein, 516 aa, Neurospora crassa
  strain ATCC 24698 / 74-OR23-1A / CBS 708.71 / DSM 1257 / FGSC 987
MRASLLAFSLAAAVAGGQQAGTLTAKRHPSLTWQKCTRGGCPTLNTTMVLDANWRWTHATSGSTKCYTGNKWQATLCPDGKSCAANCALDGADYTGTYGITGSGWSLTLQFVTDNVGARAYLMADDTQYQMLELLNQELWFDVDMSNIPCGLNGALYLSAMDADGGMRKYPTNKAGAKYATGYCDAQCPRDLKYINGIANVEGWTPSTNDANGIGDHGSCCSEMDIWEANKVSTAFTPHPCTTIEQHMCEGDSCGGTYSDDRYGVLCDADGCDFNSYRMGNTTFYGEGKTVDTSSKFTVVTQFIKDSAGDLAEIKAFYVQNGKVIENSQSNVDGVSGNSITQSFCKSQKTAFGDIDDFNKKGGLKQMGKALAQAMVLVMSIWDDHAANMLWLDSTYPVPKVPGAYRGSGPTTSGVPAEVDANAPNSKVAFSNIKFGHLGISPFSGGSSGTPPSNPSSSASPTSSTAKPSSTSTASNPSGTGAAHWAQCGGIGFSGPTTCPEPYTCAKDHDIYSQCV

SEQ ID NO: 29993 - protein, 540 aa, Neurospora crassa
  strain ATCC 24698 / 74-OR23-1A / CBS 708.71 / DSM 1257 / FGSC 987
MGFLTLFHMAFLAVSLFVSGALAAFGYTTSGNNFVIDAGSANPLIFSVSKSSCDINSIRYRGTELQYSKQGSHIGSGLGKATVSVSQINGSKSKFIKVTCVTSTLTQYMIVKEADSTIYMATYITAEPAIGELRFIARLLSDKLPYEYPYGEVSTTKGSSSTVEGSDVFVVNGQTRSKFYSSTRFIDEDSHCVYGGSDLTHVCIITPQQESSSGGPFFRDIDSNNAGESTNLYNYMNSGHVQTEDRRMGLHGPYLMTFSRSGIPKLKTVDISWFGELGVTGYVPDSQRGTVIGRATGIPSGFEGVVHWYNAAAQYWVRTAPNGDFTSPKMKPGTYTMVLYQTEFKVATSTVTVSAGKTTTASIASTFNTSHTTLFKIGEYDGQPTGFRNADKFLRMHPSDSRMSSWGPLTYTVGSSSLNDFPMAVFKSVNNPVTIKFNLGSAPSQATTLRIATTLSFAGARPQVVVNGWSAPAPAAPAKIDSRGVTRGAYRGYGEVYDVAVPAGKLISGTNTITISALSGSSGATFLSPNFIFDAVELFY

SEQ ID NO: 29994 - protein, 299 aa, Neurospora crassa
  strain ATCC 24698 / 74-OR23-1A / CBS 708.71 / DSM 1257 / FGSC 987
MKFTLPLVIFAAVASATPVAQPNAEAEAQWCRIHGQSCWKVKRVADAFANAIQGMGGLPPRDESGHQPAQVAKRQVDELAGIIALTQEDVNAYYDSLSLQEKFAPSTEEEKKTEKVAKREAEAEAQWCRIHGQSCWKKREAEAQWCRIHGQSCWKRDALPEAEPQWCRIHGQSCWKKRDAAPEAAPEAEANPQWCRIHGQSCWKAKRAAEAVMTAIQSAEAESALLLRDTTFSPVDRVGKRDPQVCNMRLHPKKVCWKRDASPEAACNAPDGSCTKATRDLHAMYNVARAILTAHSDEN

SEQ ID NO: 29995 - protein, 108 aa, Neurospora crassa
  strain ATCC 24698 / 74-OR23-1A / CBS 708.71 / DSM 1257 / FGSC 987
MQFTSVFTILAIAMTAAAAPAEVVPRATTIGPNTCSIDDYKPYCCQSMSGPAGSPGLLNLIPVDLSASLGCVVGVIGSQCGASVKCCKDDVTNTGNSFLIINAANCVA

SEQ ID NO: 29996 - protein, 154 aa, Neurospora crassa
  strain ATCC 24698 / 74-OR23-1A / CBS 708.71 / DSM 1257 / FGSC 987
MVQLTEVEDEHFQQPQVGPEEDDEDFTDTDSEISVDSDYESQETFTDRLYALRDMVSPTTRGWFYHKYSTTTNFVKSTLSFAGRAAWAVSVSGLLIGVPFAIAFAEDQNYAAMEQEARMRELGSDVLTAGGEGQAGTAEKTLAAIGGEGARPAL

SEQ ID NO: 29997 - protein, 300 aa, Neurospora crassa; identical to SEQ ID NO: 29983
  strain ATCC 24698 / 74-OR23-1A / CBS 708.71 / DSM 1257 / FGSC 987

SEQ ID NO: 29998 - protein, 293 aa, Neurospora crassa; identical to SEQ ID NO: 29984
  strain ATCC 24698 / 74-OR23-1A / CBS 708.71 / DSM 1257 / FGSC 987

SEQ ID NO: 29999 - protein, 484 aa, Neurospora crassa; identical to SEQ ID NO: 29982
  strain ATCC 24698 / 74-OR23-1A / CBS 708.71 / DSM 1257 / FGSC 987

SEQ ID NO: 30000 - protein, 480 aa, Neurospora crassa
  strain ATCC 24698 / 74-OR23-1A / CBS 708.71 / DSM 1257 / FGSC 987
MYPPALTLLLTPGLVAAAIQPQAYASSADGRYKLSSYSAPVRGTGTPGSNSTWKLTIDDTPSGRKQTIKGFGAAVTDSTVSVFNALPSAQRTALLNTLMTTAGANFAMMRHTIASSDLSANPAYSYDDSNGQTDLSLSNFNLGGRGNAMASLLAEMRRLQPGLTILGSPWSPPGWMKLNRAIQGTTVNNNLDHAYASQFAQYFVKYLQAYQAKGATIDAITIQNEPLNSRAQMPTMYIYADEAGDLIQNNIGPALRNAGLDTKIWAYDHNTDQPSYPSTVLSRAGGYVPAVAWHCYASSLDWSVLTTFHNAHPGVEQYMTECWTSAKQPTPWNWAASFTMGPLQNWASGVTAWVLGTDTNDGPHLTGSDACDKCTGLVTVDAAAGTYNLRGDYYMMAQFSKFMKKGAVVMSGTGSWTYGDGSGLESVAATNADDGSRVVVIENKFGNEIYVTVEAKSGEVWSGLVYRNSVVTWVLPAAGA

SEQ ID NO: 30001 - protein, 434 aa, Neurospora crassa
  strain ATCC 24698 / 74-OR23-1A / CBS 708.71 / DSM 1257 / FGSC 987
MHLPTVLSVIFAAAGVTAQLNDLAVAAGLKYFGTAGQEGTITSDTTYRNIINNVHEFGQLTPENGMKWDATEGQPGKFTFQSGDIVAGVAKSNGQLLRCHTLVWYSQLPSWVSNGSWNRNTLQSVIESHISNVMGHYKGQCYAWDVVNEAISDDAQGNYRDSIFFKTFKTDYFPIAFNAAKKADPNAKLYYNDYNLEYNGAKTERALELVKLIKAAGAPIDGVGFQAHMTVGGTPSRSAMATLLKRFTALGVEVAYTELDIAHKNQPSSSSVQAQQATDYANMVGSCVDVDGCVGVTIWGFIDKYNWIQNGNAAIFDSSFNKKPAYSAISSVLAAAATKAPTPAKNANSPPAVHTTLRTAIATAPACEATATAPKATAAPAAQPAKPATGSSTGAQQPRWAQCGGNGYTGPTACQAPYTCKVQNPWYSQCLGRE

SEQ ID NO: 30002 - protein, 342 aa, Neurospora crassa
  strain ATCC 24698 / 74-OR23-1A / CBS 708.71 / DSM 1257 / FGSC 987
MRSTLVTGLIAGLLSQQAAAHATFQALWVDGADYGSQCARVPPSNSPVTDVTSNAMRCNTGTSPVAKKCPVKAGSTVTVEMHQSHPPVPTLTYKQQANDRSCSSEAIGGAHYGPVLVYMSKVSDAASADGSSGWFKIFEDTWAKKPSSSSGDDDFWGVKDLNSCCGKMQVKIPSDIPAGDYLLRAEVIALHTAASAGGAQLYMTCYQISVTGGGSATPATVSFPGAYKSSDPGILVDIHSAMSTYVAPGPAVYSGGSSKKAGSGCVGCESTCKVGSGPTGTASAVPVASTSAAAGGGGGGGSGGCSVAKYQQCGGTGYTGCTSCASGSTCSAVSPPYYSQCV

SEQ ID NO: 30003 - protein, 310 aa, Neurospora crassa
  strain ATCC 24698 / 74-OR23-1A / CBS 708.71 / DSM 1257 / FGSC 987
MSEESLLERKYFDGIYIPAGLLVFGTVIVKKEWTLYAALAALILGAIKYFRMLPKKVLKPAVFQEFELKEKTIISHNVAIYRFKLPTPDSVLGLPIGQHISIGAAIEQPDGSTKEIVRSYTPISGDHQPGYFDLLIKSYPTGNISKHMASLQVGQTIRVKGPKGAFVYTPNMVRHFGMVAGGTGITPMLQVIRAIVRGRAAGDRTEVDLIFANVTAQDILLKEDLDALVAQDKGIRVHYVLDRPPEGWTGGVGFVTQEMVEKLLPKPASDVKILLCGPPPMISGLKKATEALGFQKARPVSKLEDQVFAF

SEQ ID NO: 30004 - protein, 829 aa, Neurospora crassa
  strain ATCC 24698 / 74-OR23-1A / CBS 708.71 / DSM 1257 / FGSC 987
MRTTSAFLSGLAAVASLLSPAFAQTAPKTFTHPDTGIVFNTWSASDSQTKGGFTVGMALPSNALTTDATEFIGYLECSSAKNGANSGWCGVSLRGAMTNNLLITAWPSDGEVYTNLMFATGYAMPKNYAGDAKITQIASSVNATHFTLVFRCQNCLSWDQDGVTGGISTSNKGAQLGWVQAFPSPGNPTCPTQITLSQHDNGMGQWGAAFDSNIANPSYTAWAAKATKTVTGTCSGPVTTSIAATPVPTGVSFDYIVVGGGAGGIPVADKLSESGKSVLLIEKGFASTGEHGGTLKPEWLNNTSLTRFDVPGLCNQIWKDSDGIACSDTDQMAGCVLGGGTAINAGLWYKPYTKDWDYLFPSGWKGSDIAGATSRALSRIPGTTTPSQDGKRYLQQGFEVLANGLKASGWKEVDSLKDSEQKNRTFSHTSYMYINGERGGPLATYLVSAKKRSNFKLWLNTAVKRVIREGGHITGVEVEAFRNGGYSGIIPVTNTTGRVVLSAGTFGSAKILLRSGIGPKDQLEVVKASADGPTMVSNSSWIDLPVGHNLVDHTNTDTVIQHNNVTFYDFYKAWDNPNTTDMNLYLNGRSGIFAQAAPNIGPLFWEEITGADGIVRQLHWTARVEGSFETPDGYAMTMSQYLGRGATSRGRMTLSPTLNTVVSDLPYLKDPNDKAAVVQGIVNLQKALANVKGLTWAYPSANQTAADFVDKQPVTYQSRRSNHWMGTNKMGTDDGRSGGTAVVDTNTRVYGTDNLYVVDASIFPGVPTTNPTAYIVVAAEHAAAKILAQPANEAVPKWGWCGGPTYTGSQTCQAPYKCEKQNDWYWQCV

SEQ ID NO: 30005 - protein, 440 aa, Neurospora crassa
  strain ATCC 24698 / 74-OR23-1A / CBS 708.71 / DSM 1257 / FGSC 987
MYSSSMLVALLALANSLPGALGGFSSTATGNIAIYWGQNSANQVGGQQRLAYYCRNTNVNTIPLAFLNVIRDTEMNFSNAGDDCSIFPGTKLIKCTQIEEDIKTCQSLGKSILLSIGGATYSEGGFSSPAEAISWADRLWAMFGPVSNSDKRPFGTAVIDGFDFDFEAVAQNMVPFATRLRSLMDSAAATSGKKFLLSSAPQCPFPDRANNDLLQSVAFDFVSVQFYNNYCGVHTFQFGSPSQNNFNFGTWDNWAKTVSKNKDVKILLGVPGSSSAAGTGYIAGSQLANVIKYAQTFSSFGGVMMWDMSQVWANAGFLDSVASALGSTGGSGVGITPTIETTSLPGSTTTSSTPVVQTATTWVTVTIWATATVNGPAATAKSTSTTTLWAESTTAISAPTPAAGLVNQWGQCGGNGYKGLTSCRAPYSCVKLSDWWSHCN

SEQ ID NO: 30006 - protein, 315 aa, Neurospora crassa
  strain ATCC 24698 / 74-OR23-1A / CBS 708.71 / DSM 1257 / FGSC 987
MVRISLLTYLALGLGSTTVLADCGQAPSSSPAVQIPTGVLTPVTDFGVNPTGLDLHIYVPKNLAPKPAVILALHLCGGTGPIYSYLSNYNPHADQRKNFVVLYPSTPHDNHCWDVASKKSLTRDAGGDTTSLASMVRWAISEFDADPAKVFVTGSSSGCMMSNVMAAAYPDIFSAVSCYSGIPAGCLAGSPGASPQNSDPTCGQGKKIKSGEEWAAVLKSIYGKPEGYTEGSYPKVQTWHGEADFFVNYPNLQEQLKQWSTVLDVPFSKTQANAPDTGYTKIVYGDGSKLVGYSAKGVGHTVPVHPEEDLKWFGL

SEQ ID NO: 30007 - protein, 402 aa, Neurospora crassa
  strain ATCC 24698 / 74-OR23-1A / CBS 708.71 / DSM 1257 / FGSC 987
MKISNASLLALLLPAASARFVEQAEQNRVMLFPDGIPEEPKSTTKYHIELSPGDTRWVTEDEKWELRRNGQRFFDITDHAELGTFNKRPYKKSVFPKKPTQKKDLEPLLKNLSKTEMEDHLTTFTSFHTRYYKSESGRQSSEWLLKQVRDTIKAAGADDTVTARHFEHAWGQNSIIATIPGKTNATVVIGAHQDSINLWLPSVLAAPGADDDGSGTVTILEAFRVLLQSEDIIKGNHENTIEFHWYSAEEGGLLGSQAIFTTYEKARRDVKAMLQQDMTGFVSRTLQAGEVESVGVIVDYVDPNLTDFIKKIIVEYCDIPYVETKCGYACSDHASASKAGYPSAFVIESAFEYSDNHIHTTDDLIKYLSFDHMLQHARMTLAFAYELAFADFAKLEKGHGDL

SEQ ID NO: 30008 - protein, 629 aa, Neurospora crassa
  strain ATCC 24698 / 74-OR23-1A / CBS 708.71 / DSM 1257 / FGSC 987
MSTAVRICVCGDEGTGKSSLIASLVKGVFVANKIQAVLPQVTIPPTTGTPENVTTTIVDTSARPQDRTTLRKEIRKSNVILLVYSDHYSYERVALFWMPYFRSLGVNVPVVLCANKSDLVSDGNAAQVAEEEMLPVMAEFREIDSCIRTSAKEQKNVIEVFYLCQKAVTHPIAPLFDYKEGQLKPACVDALRRIFFLSDKDQDGYLNDQEMQDFQQKSFDKPLSQEDLDNIKLTVSKSVPSSSTDKGLDLRGFLQLNKLYAEKGRHETIWIILRKYHYTDSLSLEDSFLHPRFDVPDYASAELSPAGYRFFMDLFLTFDKDNDGGLNDRELAALFAPTPGLPHSWAETSFPSTTVRNEAGHITLQGWLAQWSMTTFLEPKTTLEYLAYLGFETPNARETTTAALKITKPRKRRRRPGRVDRNVVLCYILGSSGAGKSSLLDVFLNRPFDTLYHPTIKPRQAVNSVELQGGKQCYLILEELGELEPAILENQAKLDACDLICYAYDSSEPDSFSHIVELRKRYPQLDELPAVYTALKADRDKTTQRSELQPDAYTAALNMSAPLHVSVTWNSISELFVALAEAATNPSTAFPRSEEPPADRASLYMALGATACAALAAFMIWRRSTSNAA

SEQ ID NO: 30009 - protein, 588 aa, Neurospora crassa
  strain ATCC 24698 / 74-OR23-1A / CBS 708.71 / DSM 1257 / FGSC 987
MAFNFNWSPLTADAGFYERARDLLTTALNKSPKPPIIVDDIFVTELNLGSVPPDLEILEIGDLAEDRFRGIFKMCYSGDAFLTLATRVQANPLNTYISAKPSFTSPEPLTASSSLTIPLQITLSEIKLSAFIILVFSKQKGLTIVFRNDPLESLKVSSTFDSIQFVRDYLQKTIEMKLRDLIMDELPAIIHRLSLQLWCPDQVPKEDEEAKEESDAAINPLATPPLDAVDAHGHRLDPAEISSLSLDGGPETQSLFSQKNLEKMDALASAHRTSSLLTPNILEVVFRAWAGQSDKPDATATPASTPNLHRTSSYQGSVHTYTFSDNSSQASGHALSRPTLVSMGSATTGLSLGSGRHSKAGRKKKMRVVNLRSKTAVSEPVSEIGSTSSQAGDSHTEASTRTPMSEPVIPTTIREVPEDDLAASQSKVRFRPPTDATTSARASESSGPRAAVPSVPVTAQPSRATSSQEHVYTRQPSMFPSSPAPQTSAQEMPPSYSSRVSEKAESTASIYADAKGQQQQFQQQQQQQQQQQQQQQQQQQQQQQQQQQQQQQQQQQQWGRAGPQPDMSSVILEQAWITKIAGEIARRV

SEQ ID NO: 30010 - protein, 392 aa, Neurospora crassa
  strain ATCC 24698 / 74-OR23-1A / CBS 708.71 / DSM 1257 / FGSC 987
MAALKLGFMALAPALAAAADIPLWGQCGGIGWQSAGSACTSVATCTSFNDYYYQCVPKPTSAAVVTTSSKPVTVSAAPTTTNKGGSSTFSTSIKPSSSSTEPTSSSTQPSFVPVPTSTSAKYLISFGDSYSQTGFDINGSKPSSSNPLGNPPLPGWTASGGLNWVGFLASQLNTSLTLSYNFASGGATTNASLVAPFAPTVLSFVDQVAQFSGSIASRPAYAPWNSENSLVAVWIGVNDVGNTWWMGESEMDALYGQIMDSYFGRLQVLYDAGARSFALLGAAPIYYTPSTIGQGATTVAAQKVAIAKYNSLLASRFDAFLEANTDATGKIVDTVAPFETAIKNPTAYGAPDATCFNEDGVSCLWFNDYHPGVQIQKLVAQAVKSAFTGTFF

SEQ ID NO: 30011 - protein, 421 aa, Neurospora crassa
  strain ATCC 24698 / 74-OR23-1A / CBS 708.71 / DSM 1257 / FGSC 987
MVGLKNVALFAASIILPASITWAAPIIEVETKPIPEKYIVLLKPHADLEGHLSWAKDVHARSLSRRDTAGVHKAWSVGSKFKAYAGEFDEETLKIIQRDERNVHSIEPDKSWRLYKSNKKDNDDSNSDNTTIITQKQAPWGLGYLSHKGKTSSDYVYNSTAGTGTYAYVVDTGCWKDHVEFEGRVQLGYNAYPDSPFIDMDGHGTHVTGTLISKTYGVAKNATVICVKVFHGGGSANTIVMDGFEWAVKDIIAKKRQRNSVINMSLGCDRSEAFNAIVDAAYDQGILTVVAAGNENQPAALVSPASSARAFSVGAIDNKNTRAYFSNYGAIVDIFAPGVNIVSTYIGKKDGDNNRTMTMSGTSMASPHVAGLALYLKSLDPEKYGNSSDAHSGLRALGVPDKVWDAGEMSPNLVAYNGVQG

SEQ ID NO: 30012 - protein, 369 aa, Neurospora crassa
  strain ATCC 24698 / 74-OR23-1A / CBS 708.71 / DSM 1257 / FGSC 987
MARMSILTALAGASLVAAHGHVSKVIVNGVEYQNYDPTSFPYNSNPPTVIGWTIDQKDNGFVSPDAFDSGDIICHKSAKPAGGHATVKAGDKISLQWDQWPESHKGPVIDYLAACDGDCESVDKTALKFFKIDGAGYDATNGWASDTLIKDGNSWVVEIPESIKPGNYVLRHEIIALHSAGQANGAQNYPQCFNLKVEGSGSTVPAGVAGTELYKATDAGILFDIYKNDISYPVPGPSLIAGASSSIAQSKMAATATASATLPGATGGSNSPATSAAAAAPATSAAAATSQVQAAPATTLVTSTKAAAPATSAAAPAAPATSAAAGGAGQVQAKQTKWGQCGGNGFTGPTECESGSTCTKYNDWYSQCV

SEQ ID NO: 30013 - protein, 84 aa, Neurospora crassa
  strain ATCC 24698 / 74-OR23-1A / CBS 708.71 / DSM 1257 / FGSC 987
MKASIVLVSFLGLVSGMVLPGHRLSPSGAKLQPRSLFKREANLDYRYAPEPCRAILTTCRVTSDCCSGMKCVSADGESVCTPSD

SEQ ID NO: 30014 - protein, 836 aa, Neurospora crassa
  strain ATCC 24698 / 74-OR23-1A / CBS 708.71 / DSM 1257 / FGSC 987
MRVSWGLLAFPAAASAIENGINGWLRYAPLPNNERPPNLRLPGAIMALSTNKTSPVYTAGQELQAGIKGILNQTLPLYHEPDEWLGSTILVATTGEFHGGKPAATLADDGYLLHVRPGNVVILGQTERGALYGAFDYLSRIAQGRFSDADLIANPDAPIRWVNQWDNMDGSIERGYAGASIFFRNNTIPKDLNRVSQYARLLASIGINGIVVNNVNANANLLTDANIDGLGRIADAMRPYGVQIGISLNFASPQTLGGLSTFDPLDRSVISWWTDKTNRLYRRIPDMAGYLVKANSEGQAGPLTYNRTLADGANLFAKAVQPHGGIVMFRAFVYDNHINPADLKADRAKHAVEFFKGLDGQFLDNVVVQIKYGPIDFQVREPASPLFANIPQTNTAIELQITQEYLGQQSHLVYLAPLWETILNFDLRADDQPSLVRDVVAGHRFSNKRGGYAGVVNVGTNTTWLGSHLAMSNLYAYGRLAWNPNQDPQALLEDWTRLTFGSDPLVLGVVTEISMASWPAYENYTGNFGIQTLTDILYTHYGPNPASQDNNGWGQWTRADHNGIGMDRTVSTGTGFSGQYPAEVAEKFESIETTPDDLLLWFHHVNYTHVLKSGKSVIQHFYDAHYAGAETAQTFPIAWESLRNKIDTERFNDVLFRLRYQAGHSIVWRDSICQFYYNLSGIPDSTGRVGKHEYRIEAEAMALKNYKLTGVNPVETASNLTAVVLVSNHTSGEATTKLNFDSGKYDVTINYFDLIGGKAHYKAFLNGKLLLEWAGDLEDKLGHTFSTKLDGHSATRVTIRDVQIQKGDVLKITGVADGNELAPLDYIAVLPQGVVD

SEQ ID NO: 30015 - protein, 405 aa, Neurospora crassa
  strain ATCC 24698 / 74-OR23-1A / CBS 708.71 / DSM 1257 / FGSC 987
MKFTLLSGLVAQALSVSAGSILWDGRFNDLTSATDLSKWSWSSQVGPYQYYIHGPSEVTSYVNLSPSFKNPADSGSSQGAKITLDKTAFWNGQTMRRTELIPQTTAAINKGKVFYHFSLMRKDTNAPALTREHQIAFFESHFTELKSGWQSGAAGTSDPLLRWCIGGQTKWSVNWDADVWHNVAYEIDFDANTVGFWHSTGSDALTQVIAPQAAGTSSNGADWHVGVLELPRDGYADATEDFYFSGVYIESGSITTSVAGPGSSSSNPGTPSAPSSSSAVPVKPSTSSASVAPVKPSTSSTSSSTTVAAVTSSAAPVKPSTSSASSSTTVAAVTSASAAPAVTTSKAGTKTCTRKSSAAPAATTSAGSCTAARYAQCGGKGFSGCTACASPYKCNKVNDWYSQCY

SEQ ID NO: 30016 - protein, 861 aa, Neurospora crassa
  strain ATCC 24698 / 74-OR23-1A / CBS 708.71 / DSM 1257 / FGSC 987
MKSISVIQLLLAAAAAPVRAAASWKNVNIGGGGGFVPGFVFHPTEKGVAYARTDIGGLYRLNADDSWTAITDSITTDDKWNNWGIDAVALDPQDPDKVYAATGMYTNSWDPNNGTLIRSSDRGATWSSTELPFKVGGNMPGRGMGERLAVDPKNSKIIYFGARSGHGLYKSTDGGVTFSKVSSFTAVGDYVVDPSDTTGLNNDKQGIAFVTFDSTSATTNGATSRIFVGSATNSTSSVWVSNDAGATWSAVAGQPGTYFPHKCKLQPTEKALYLTYSDGTGPYDGTAGAVYRYDITNGTWKDITPGSDLAYGFGGLGVDMKNPGTIMVASLNLWWPDAQIYRSTDSGATWSPIWEWDGYPNMNQYYGLTTPNAPWIETGFLSQDTKHLGWMIESLEINPLDSDHWLYATGLTVYGGHDLTKWDTVHNVTIQSLAVGIEEMAVLGLASAPGGSELLAAVGDDCGFTFKSSSDLGTSPKTPWMTPQWASSADVDYAGNKPANVVRIGSGSGAQQVAVSSDGGASWHAHNGTDTTKSSGTVAYSADADTIVWSSGTSGVVRSQNQGTFTAVASLPSGAVIASDKRNNTVFYAGSTTGTFYRSTDTGATFTAVSDALGSAKAVRDIVAHPTVAGELYVSTDAGIFRSTDFGVSFTKLSGLTNTQSVSLGVGSTSGSWNLYAFGTGANGNKLYASADAGATWADVQGAQGFGSIAVASSKVAGSANVPGQVYVGTNGRGVLYAQVSVSGTAPGATSSSSAPVKTSSSTAAAAPSSSAAVKTSSTSAAAPVSTTTSKAAATTTTLVTSTVKPTTATLTLSSVKSTSTVGAELAQHWYQCGGVGWTGPTACVSPYKCEKQNDYYSQCV

SEQ ID NO: 30017 - protein, 312 aa, Neurospora crassa
  strain ATCC 24698 / 74-OR23-1A / CBS 708.71 / DSM 1257 / FGSC 987
MKLLSLATALLATLTTAHPVFDDLITPSTPLDHKRAPAASLRHISNFGSNPSNAKMYIYVPDNLAASPPIIVAIHYCTGTAQAYYTNSPYARLADQKGFIVIYPESPYSGTCWDVSSHATLTHNGGGNSNSIANMVEYTLKTYNGDATKVFVTGSSSGAMMTNVMAATYPALFAAGIVYSGVPAGCFYSQAGGTNAWNSSCANGQVHGTPQVWAKVVRDMYPGYDGARPKMEIYHGSADTTLNANNYNETIKQWAGVFGFDYQKPDTTQDNVPQGGYTTYTWGEGKLVGVYARGVGHSVPIRGSDDMKFFGL

SEQ ID NO: 30018 - protein, 904 aa, Neurospora crassa
  strain ATCC 24698 / 74-OR23-1A / CBS 708.71 / DSM 1257 / FGSC 987
MCRTQAQADVASGVNIQGRELLPTNVIPKHYHITLEPDFQKLTFDGTVVIDLDVEEDSKSISLHTLEIDIHNAKITSGGQTVSSSPKVSYNETTQVSTFDFDNAVNKGAKAQLEIQFTGQLNDKMAGFYRSTYINPDGTQGLLAVSQMEPTDARRAFPCFDEPSLKAEFTVTLIADKKLTCLSNMDVASESEVKDGKKAVTFNKSPLMSTYLVAFVVGELNYIETNDFRVPVRVYAPPGQNIEHGRFSLDLAAKTLAFYEKVFGIEFPLPKMDQIAIPDFAQGAMENWGLVTYRVVDLLLDEKVSGAATKERVAEVVQHELAHQWFGNLVTMDWWDGLWLNEGFATWASWYSCNIFYPEWKVWETYVTDNLQRALALDSLRSSHPIEVPVKRADEINQIFDAISYSKGSCVLRMISTYLGEDVFLEGVRRYLKKHAYGNTQTGDLWAALGDASGKSVEEVMDVWTKHVGYPVVTVTEKDEKTIHVKQNRFLRTGDVKPEEDKVIFPVFLGLRSKDGIDESLTLDKREDSFEVPSTEFFKLNANHTGLYRTSYTPERLEKLGEAARQGLLSVEDRAGMIADAGALASSGYQKTSGVLTLLKRFDSEKEFIVWSEIISRVAAVQAAWIFEDKAVRDGLEAFQRELVSPRAHEMGWEFSESDGHIEQQFKAMLFGNAGLCGDEKIIAAAKEMFKKFIAGDKSAIHPNIRGSVFSIALKYGGTEEYDAVLNFYRTSTNSDERNTALRCLGRARSPELIKRTLDLLFSGEIKDQDVYMPTAGLRSHPEGIEALFNWMTENWDELVKRFPPQLSMLGTLVTIFTSSFTKREQLAKVEKFFEGKNTNGFEMSLAQSLDAIRSKVAWVERDGEDVAKWVKDNKYSSSENGTPSATRSDILQMEVADAASSRI

SEQ ID NO: 30019 - protein, 507 aa, Neurospora crassa
  strain ATCC 24698 / 74-OR23-1A / CBS 708.71 / DSM 1257 / FGSC 987
MEERKQKVVVVGAGPVGSLAALYAANRGHDVEIYELRGDLRDPSTTPLNFTRSINLALSERGLNAMRHANQPRLIDYVKGVTIPMRGRMIHGKRPDGKLYEEAQDYDIHGRVRPLPSTPLPFYRAEMPNVTFFFNHKLTGADFKRNKAWFENKDESTSNPRDRAREIEVDFDFMIGADGAHSAVRYHLMKFSRMDYQQEYIDTLWCEFQIAPSSSSAKSKFRISPNHLHIWPGKEFMFIAIPSNDGSFTCTLFAPAAIYEQLEEAGRTGDTSSSIPEFFDMHFPGVTSLIAPADLIAQFQTNPHLPLISIKCKPYHFSSSVVIVGDAAHAMVPFYGQGMNAGLEDVRILFDILDKHDRMTNDDSSLEASQRELALAEYSAVRVADAHAINDLALQNYIEMRSSVLSPVYRWRKALEEWLSVYVPSLGWQTKYSRVSFGNERYSEVVKKSERQGQVLLRSLVGGVGLPMLAGGLFLWFRYKGALGRAAYGVFYNCMGMVCRTIHGRRR

SEQ ID NO: 30020 - protein, 97 aa, Neurospora crassa
  strain ATCC 24698 / 74-OR23-1A / CBS 708.71 / DSM 1257 / FGSC 987
MQFTIATVLSLLTITLAAPAAMERQVPYTPCSGLYGTAQCCATDVLGVADLDCANPPATLANATHFESTCAAIGQRARCCVLPILGQDILCQTPAGL

SEQ ID NO: 30021 - protein, 322 aa, Neurospora crassa
  strain ATCC 24698 / 74-OR23-1A / CBS 708.71 / DSM 1257 / FGSC 987
MKVLSLLAAASAASAHTIFVQLEADGTTYPVSYGIRTPSYDGPITDVTSNDLACNGGPNPTTPSDKIITVNAGSTVKAIWRHTLTSGADDVMDASHKGPTLAYLKKVDDALTDTGIGGGWFKIQEDGYNNGQWGTSTVITNGGFQYIDIPACIPSGQYLLRAEMIALHAASSTAGAQLYMECAQINIVGGTGGTALPSTTYSIPGIYKATDPGLLVNIYSMSPSSTYTIPGPAKFTCPAGNGGGAGGGGSTTTAKPASSTTSKAAITSAVTTLKTSVVAPQPTGGCTAAQWAQCGGMGFSGCTTCASPYTCKKMNDYYSQCS

SEQ ID NO: 30022 - protein, 252 aa, Neurospora crassa
  strain ATCC 24698 / 74-OR23-1A / CBS 708.71 / DSM 1257 / FGSC 987
MSLNMKSLSLLAVASLASAGATNTNLQTTFPTPSGTTALPAVKTIAAGGSFDGGMYQWDRWPSTCNQQSEGGDKDAVFILEDGATLSNVVIGPNNGEGVHCKGRCTLNNIWWTDVCEDAATFKQTSGTSYVNGGGARHASDKVLQHNGGGTVAVKNFYATDIGKLYRSCGNCKTQHQRSSTFTNVHVEGAKVVAGVNANYGDKTTIKNSCIKDSSVCWLYEGTSNNSKEPKKIGSGPSGTACAVAALKTSGC

SEQ ID NO: 30023 - protein, 82 aa, Neurospora crassa
  strain ATCC 24698 / 74-OR23-1A / CBS 708.71 / DSM 1257 / FGSC 987
MAQAGSENKEPWNEETRAKFEGKSRSEYLDPCQEAAQRSIRCLHRNQGDRTMCSDYFEAYRECKKQWIERRREQKRKAGALF

SEQ ID NO: 30024 - protein, 364 aa, Neurospora crassa
  strain ATCC 24698 / 74-OR23-1A / CBS 708.71 / DSM 1257 / FGSC 987
MAASIPSTSGNHIKASSSCTFSGSTGFDLLNKGHSSCQEIVISDLQVPAGKTLSLDKLNPGTTVTFSGKTTFPYTSSGFAGPLLSISSSSKLTIRGLSSSVLYGSGEKYWDGLGQKGPIKKPKFFQVHNLEDSVIEGVTILNAPVQVMSINGCKNLTVTSFTLDNKAGDGDWKAGKGGRNTDAFDIGSSSNIVIDGAKVYNQDDCVAINSGTDITFRNGLCSGGHGLSIGSVGGRSDNTVKNVLFENSVIANSENGARIKTNYGTTGLVSNITYRNVKLQNITKYGIMVDQSYGSSSKNASPTNGVPITGFTLSNVTGNVLSSGTNIFINCGDGSCKQFEWNQVDVKGGKKSSKCLRVPSGAWC

SEQ ID NO: 30025 - protein, 314 aa, Neurospora crassa; identical to SEQ ID NO: 29980
  strain ATCC 24698 / 74-OR23-1A / CBS 708.71 / DSM 1257 / FGSC 987

SEQ ID NO: 30026 - protein, 153 aa, Neurospora crassa
  strain ATCC 24698 / 74-OR23-1A / CBS 708.71 / DSM 1257 / FGSC 987
MTQLPYAVDAETPLNPAELNVLRAQYEKEGEMVGVQTKFNYAWGLVKSNVRADQHLGVMLLSEIFRTSPERRRECLYYLALGNYKLGNYAQARKYNDALLENEPANLQAANLRALIDDKVTKEGLMGVAIISGVAVAAGVIGGVLLRNLGRKR

SEQ ID NO: 30027 - protein, 645 aa, Neurospora crassa
  strain ATCC 24698 / 74-OR23-1A / CBS 708.71 / DSM 1257 / FGSC 987
MLRPACCQPQRPTTEGPTRGLEAFGRKVTTTASHLIGPITDPTSHPHYQTAMTEIHKQLQKPTLQRGVFAIARTTPTDLVRSKLSSKEIQSRALAYVPDELLRNIPASSNSYSLFQGFQASFPDFTDDGKKHKRRVSRGRKMLDESPVQPGSPHAVQRLKKDKASMMHQLEMLGVRKNMASSEIREIDNKIANLHGMRKIILDRLANLEKEEAVLEHDIMDVESRLDEAQELADEAESLAMATPNKSEEDLSRTEEGFMSQSIYEKLPAANTPPGKKKPRNHRKKTLPILHEHFEPGTMIRSMRAHQDNITALDFDAPFGLMVSAAMDDSVRVWDLNAGRCIGTLEGHTASVRTLQIEDNFLATGSMDATIKLWDLSKAHYDPQGSQEVDEEDEDLAFVNPNDHAVDPPAGSMADCPLFTLEAHLDEITALHFRGDVLVSGSADKTLRQWDLTKGRCVQTLDVMWAAAQATAMGSSDGPWRQTSRSADGSADFVGALQVFESALACGTADGMVRLWDLRSGQVHRSLVGHTGPVTCLQFDDVHLVTGSLDRSIRIWDLRTGSIFDAYAYDHPITSMMFDTRRIVCAAGEDVVKVYDKVEGRHWDCGAGITEAEKAKSPAIVERVRIRDGYMVEGRQDGVVGVWTC

SEQ ID NO: 30028 - protein, 811 aa, Neurospora crassa
  strain ATCC 24698 / 74-OR23-1A / CBS 708.71 / DSM 1257 / FGSC 987
MSAALRFWLRGQSAASNQSSKAPSAAPSPAASSTSLRDQFNKHGRSSTGSVSAAQQEASNIEDAMAAVALIMNDDIDGAEAMLRAREDASTFHQLGVGVSTFLRSILGFEKDIMNEATTRLGETETRAWNDMKKAQKEAEKHGVYGGSVYPQGHPSGGSHIYPPGSEFALVNAEAQLMGAVVAVMHESLTEGIKGFYKLRKAYATLDGIMASELLYLQTLEKKGIITNASSTKTSLDKMPGAFSDSEFATLENTKGANTPSQNGAAADSASVAKDPSGPQTPASASASNEAKTAADVDILDEKLGHLQLDADAASEQNVLPDASLEDTTPSTPQFSHLDQLNKFGADRSLFKSPVDIFVHSGASMCFGILLLIISMVPPAFSRLLSVIGFKGDRDRGVQMLWQSTKYDNVNGAMAGLVLLQYYNLFFGIADILPSELDIQQLSKPSTGGAKFEAVGYPHNECTALLAQMRHRYPDSRLWRLEEARVLANARRIEEALAMLADNNDSKMRQIAALNSFELSMNSIYALDFKAAPVHFLRCVELNSWSHALYYYLAACAELELYRDLFHSGEATSPAALKHKKLAEEYFRKAPTVAGKKRFMAKAMPFEVFVLRKLQKWEERVKAYGLDLADVICVSPAMEMIYLWNGSKRMPPHLLEKARTYLPWERCTAPADKDVVAKIKKLEQDEVAIGLLAESSFLRQLGKSVEARKLVEPLLGVDKSVFKGPTRDDYCGAAAHYEVAAVAWMEACSPEAWPSAPEEVESFRKQKTDECQLHLDKVSKWDGFVLDARFGMRVQAGIDSVKWLKSKKGWM

SEQ ID NO: 30029 - protein, 521 aa, Neurospora crassa
  strain ATCC 24698 / 74-OR23-1A / CBS 708.71 / DSM 1257 / FGSC 987
MLAKFAALAALVASANAQAVCSLTAETHPSLNWSKCTSSGCTNVAGSITVDANWRWTHITSGSTNCYSGNEWDTSLCSTNTDCATKCCVDGAEYSSTYGIQTSGNSLSLQFVTKGSYSTNIGSRTYLMNGADAYQGFELLGNEFTFDVDVSGTGCGLNGALYFVSMDLDGGKAKYTNNKAGAKYGTGYCDAQCPRDLKYINGIANVEGWTPSTNDANAGIGDHGTCCSEMDIWEANKVSTAFTPHPCTTIEQHMCEGDSCGGTYSDDRYGGTCDADGCDFNSYRMGNTTFYGEGKTVDTSSKFTVVTQFIKDSAGDLAEIKRFYVQNGKVIENSQSNVDGVSGNSITQSFCNAQKTAFGDIDDFNKKGGLKQMGKALAKPMVLVMSIWDDHAANMLWLDSTYPVEGGPGAYRGECPTTSGVPAEVEANAPNSKVIFSNIKFGPIGSTFSGGSSGTPPSNPSSSVKPVTSTAKPSSTSTASNPSGTGAAHWAQCGGIGFSGPTTCQSPYTCQKINDYYSQCV

SEQ ID NO: 30030 - protein, 481 aa, Neurospora crassa
  strain ATCC 24698 / 74-OR23-1A / CBS 708.71 / DSM 1257 / FGSC 987
MREFMNYITNAFYGATGWNEDNKYNELNATSRELIDFPLPRGLRLTLSSLATPHFATSYQLGSVGVVDGSISYLHSSIPLTHIAAQSDKIPLPALLRCYRRLHDLRSPGQQHYILDADPLSGLPPPPQSARALLGAASDAAVAGGALDGGNTDQDLGIYTHSLLYGRLYLPKSLLEGMIIKRFTQALQVQVRAVSEQSLRNGGTILGLVQYDKGKYGLEGLYSTDGGLLGFRGLYNFGGDASSSTCDPWTPTPGENNNNNNNNNNNNNGNAQAGEKERIYGRFSVGGELYYGTLNKSGGMSLGARFATLPAHRGTPLTATLTINPLMGNINATKYALLAREYCSLATRVDFNVYSYESEWAVGMELWSNRRPAGFLLGASPSNDFEPEPHPPRKKERSFQAKMEWRLDDPEPEPEPQPTPKTRKNDEYKGVLKARLDNNLRMGLLWEGRAKSLIFSIGTGIDLHKLGEPFRSLGLEVQYSS

SEQ ID NO: 30031 - protein, 709 aa, Neurospora crassa; identical to SEQ ID NO: 29979
  strain ATCC 24698 / 74-OR23-1A / CBS 708.71 / DSM 1257 / FGSC 987

SEQ ID NO: 30032 - protein, 326 aa, Neurospora crassa
  strain ATCC 24698 / 74-OR23-1A / CBS 708.71 / DSM 1257 / FGSC 987
MKLSVAAALSLAASEASAHYIFQQVGAGTSVNPVWKYIRKHTNYNSPVTDLTSKDLVCNVGASAEGVETLSVAAGSQVTFKTDTAVYHQGPTSVYLSKADGSLSDYDGSGGWFKIKDWGATFPGGEWTLSDTYTFTIPSCIPSGDYLLRIQQIGIHNPWPAGVPQFYLSCAHISVTGGGSASPATVSIPGAFKETDPGYTVNIYSNFNNYTVPGPEVFTCSGSGSGSGSGSGSGSTPPSQPTTSTTLPTSSTVVATTLKTSTVVATTKSSSSTTSSASSSGSQPTSPSGCTVAKYGQCGGIGYSGCTSCASGSTCKVGNDYYSQCL

SEQ ID NO: 30033 - protein, 390 aa, Neurospora crassa; identical to SEQ ID NO: 29977
  strain ATCC 24698 / 74-OR23-1A / CBS 708.71 / DSM 1257 / FGSC 987

SEQ ID NO: 30034 - protein, 399 aa, Neurospora crassa
  strain ATCC 24698 / 74-OR23-1A / CBS 708.71 / DSM 1257 / FGSC 987
MKFSSFASGLLALGASLASAAEVVKRASLQQVANFGSNPSGVKMYLYVPNKLATKPAIIVAIHYCSGTAQAFYQGTQYAQLAEKYGYIVSAGLLVIYPESPYKGTCWDVSSPASLTHNGGGNSNSIANMVTYTIKQYGADASKVFVTGTSSGAMMTNVMAATYPELFAAASVYSGVSAGCFATGTVNGWNSTCSQGHSIHSQEEWANVVFNMYPGYEGPRPRMMIHHGSADTTLYPQNFNETLKQWAGVFGYTYGQPQQTLANQPASGWTKYVYGPNLVGAYGTGITHATPMFPEDDLEWFGITGNNNNNNNASPSKAAPPATTHAAAVAAPTTTLLACVRPSTAPATPSSAAPAAPASKGGCTVQRWGQCGGNGYTGCTACASSTTCKKMNDWYSQCV

SEQ ID NO: 30035 - protein, 675 aa, Neurospora crassa
  strain ATCC 24698 / 74-OR23-1A / CBS 708.71 / DSM 1257 / FGSC 987
MSIDLNWDTVTGGPDGQELAQKIRDFIHEKFQAVPLPRFIKSVTVHDFEFGSIPPEIELKDITDPLPDFYEEQPGIDSSEESDSEEEVAYENEGEYLDDPVEQQYGRLRGASASESRRRLTVNSSTGSRNGSGPNSGRVAYLPPHLNPHYNGGSGNNSSPSLDRDGRYYRDPNTAGLGGPAHGTNHHHADLGSPFLGVSTPGIPGGTSNLNLHYFTSQFTAGLSGTQTPLAAVAGAAHQRGPSWIADQQQQQQQQNNMLPGGAGGGGAGGGGMGGPVAAAAAAAAATNQGLHSSSTPHLRLHFPGVGTGKPTPGPSPLTGTSTPLGTLGTAGGVGGIGRGMGMAGMGSMASMGYPPTAPVLAIPTGPRHKRNPSSQSLNSVGDYSPVAPAPAERQGLFSAAAATSPPSSTPSPAVGLGIGGRGIGAAGAGAGALATSGPRLQIPKQGLREKHSVSTLAPNSAGTSNNRAGSAILDDDDGFLDGMHDHRDHPAQQQLEPEEDEEEEEEGEEERQRFREPRVEDIQAVFRIKYAGDVKLLLTADILLDYPMPSFVGIPVRLSITGLTFDGVGVVANIRKRVHFCFLSPEDAVAAVGGEENKAAGSGNGSGIGGGSDGAKTKMGGLLQEIRVESEIGQRESGKQSLKNVGKVERFVLEQVRRIFEEEFVYPSFWTFLV

SEQ ID NO: 30036 - protein, 148 aa, Neurospora crassa
  strain ATCC 24698 / 74-OR23-1A / CBS 708.71 / DSM 1257 / FGSC 987
MYALRPTLRRSAAAALTHSKNHNYGMTPGPLALLPPIYLYRRLLRAHRKYLPREMRLLGDEYVKAEFRAHRSVDNPAHLIGFLTEWQLYAQKIEGNSWVGEKLDKGKVEKMSDEQIGQLYELMQAIQKRGTEGDLEDGDGGESGQKSQ

SEQ ID NO: 30037 - protein, 343 aa, Neurospora crassa
  strain ATCC 24698 / 74-OR23-1A / CBS 708.71 / DSM 1257 / FGSC 987
MSLFVASTRSAFRAAAPIKRSFQTRRSYATEPSKGGSSSTILLGAAAVGLAGAGAYFFSGAGAAKKAEASVKQVTEKITPGEIKKAFVGGDQGWLSLKLEEVELVNHNTKRLRFRLPEDDMVSGLHVASAILTKFKPIDAEKAVLRPYTPISDESAQGYIDLLVKKYEGGPMSTYLHDMAPGQRLDIKGPLPKYPWEANKHKHIALVAGGTGITPMYQLIRAIFNNPDDKTKVTLVFGNVSEEDVLLKHELATIENHYPQRFRAFYVLDNPPKEWAGNKGYINKDLLKTVLPEPKNEDIKIFVCGPPGMMNSISGNKKSPRDQGELTGILKELGYSPDQVYKF

SEQ ID NO: 30038 - protein, 332 aa, Neurospora crassa
  strain ATCC 24698 / 74-OR23-1A / CBS 708.71 / DSM 1257 / FGSC 987
MKSSLILAASGALMASASPILQDRRVHFTTKVVEEWVTVTVTAGNVPFATVNAFHEHGPGRPVFSPHPQEASAATVQPTSQAPAPVPTPSSSSIVVFAPPPAPETTSSTVIIVPVSSSTQQPAPTTAPAVVAAPPATTSTMQEHATTKVDSPAAPSGSDYASTLLYHHNIHRSNHSAGAMTWGETYANYAQQAAASCVFQHDLTPGGGGYGQNIAMWGSSDKQTVQNVGAVKAGAQATTNMWYNGELSLWPASDYGKANPDMSNFEGWGHFSQLVWKESKELGCYTQFCPQGTMSSQMDVWYTVCNYYPAGNMGGEYGTNVSPPLNEALVVA

SEQ ID NO: 30039 - protein, 344 aa, Neurospora crassa; identical to SEQ ID NO: 29976
  strain ATCC 24698 / 74-OR23-1A / CBS 708.71 / DSM 1257 / FGSC 987

SEQ ID NO: 30040 - protein, 359 aa, Neurospora crassa
  strain ATCC 24698 / 74-OR23-1A / CBS 708.71 / DSM 1257 / FGSC 987
MKTGSILAALVASASAHTIFQKVSVNGADQGQLKGIRAPANNNPVTDVMSSDIICNAVTMKDSNVLTVPAGAKVGHFWGHEIGGAAGPNDADNPIAASHKGPIMVYLAKVDNAATTGTSGLKWFKVAEAGLSNGKWAVDDLIANNGWSYFDMPTCIAPGQYLMRAELIALHNAGSQAGAQFYIGCAQINVTGGGSASPSNTVSFPGAYSASDPGILINIYGGSGKTDNGGKPYQIPGPALFTCPAGGSGGSSPAPATTASTPKPTSASAPKPVSTTASTPKPTNGSGSGTGAAHSTKCGGSKPAATTKASNPQPTNGGNSAVRAAALYGQCGGKGWTGPTSCASGTCKFSNDWYSQCLP

SEQ ID NO: 30041 - protein, 285 aa, Neurospora crassa
  strain ATCC 24698 / 74-OR23-1A / CBS 708.71 / DSM 1257 / FGSC 987
MQIKSFLLAAAAAPAALGAAVNTIKPFNCGTDAPSRQHIQMTKELAEKEAAMAAEGIMTAQATINVNVYFHVVAASTALSDGYVTSTMINNQVATLNKAYAPHNIQFTLKGTDYTINSNWAVDGSELAMKKALRKGTYKDLNLYILKDLGDALGYCYFPTSVTSKSNDWYYDGCSILYDTLPGGSLTNYNLGHTSTHEIGHWFGLYHTFQGGCSGNGDYVSDTPAQASASSGCPTGRDSCPSQPGLDPIHNYMDYSYDTCYEEFTSGQRTRMTSYWNQYRANASV

SEQ ID NO: 30042 - protein, 333 aa, Neurospora crassa
  strain ATCC 24698 / 74-OR23-1A / CBS 708.71 / DSM 1257 / FGSC 987
MSPITLDLTSDFNPANTTGAGSSSSQPRTLLVAPPSVASHEERISALFSTYPRDTTDLHMLDRLAAGLVTLPTSTYDLILVLTDPDGSRHAEASALLSNRAVWSLLVPALKAGGKLRSEDGTLGRDTTTPEAREAVLAGLVAGADGFTKPDYAEEEAVPLRFGLKRKTNPNPVVAPIQPVAQVVTAAPAGVGFVTLDLNDDLDLDGEDDDDDVIDEDTLLTEADLRRPIQQPPECQPKPGKKRRACKDCTCGLAERLEAEDKARRDKADQALNTLKLKSEDLLELDLTVPGKTGSCGSCALGDAFRCAGCPYLGLPPFKVGEEVSILNNVPQL

SEQ ID NO: 30043 - protein, 130 aa, Neurospora crassa
  strain ATCC 24698 / 74-OR23-1A / CBS 708.71 / DSM 1257 / FGSC 987
MSAEEISNPLAESGVTISSDSEQYSAPESASPQSPSSSSPAVVLYQPPTVWSLFRSAVINLFLPFVNGMMLGFGELFAHEAAFRLGWSNTKVFPVSRRDARPIGPGVEVVERPRRRVDLDDHLDELTSLE

SEQ ID NO: 30044 - protein, 736 aa, Neurospora crassa
  strain ATCC 24698 / 74-OR23-1A / CBS 708.71 / DSM 1257 / FGSC 987
MSNIISQAGQKAKEALTSAPSSKKVDDLKNEFKETDKSARLTTDYGVKQTTADDWLRIVSDDKIGPSLLEDPFARERIMRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 30045 - protein, 278 aa, Neurospora crassa
  strain ATCC 24698 / 74-OR23-1A / CBS 708.71 / DSM 1257 / FGSC 987
MGFIDDEVKRLGDVIASLEDRVRSLETRDFSGKPVTTAEQLRMVLMGPPGAGKGTQAPKIKEKFNCCHLATGDMLRAQVAKGTALGKQAKKIMNEGGLVSDDIVIGMIKDELENNKECQGGFILDGFPRTVPQAEGLDAMLRERNLPLQHAVELKIDDSLLVARITGRLVHPASGRSYHRIFNPPKDDMKDDITGEPLVQRSDDNAEALRKRLETYHKQTAPVVGYYQNTGIWKAIDASQEPAQVWKSLLAIFEGDKAKASSAGSGIMSKIASAAKSS

SEQ ID NO: 30046 - protein, 292 aa, Neurospora crassa
  strain ATCC 24698 / 74-OR23-1A / CBS 708.71 / DSM 1257 / FGSC 987
MLPRTLLGLALTAATGLCASLQQVTNWGSNPTNIRMYTYVPDKLATKPAIIVALHGCGGTAPSWYSGTRLPSYADQYGFILIYPGTPNMSNCWGVNDPASLTHGAGGDSLGIVAMVNYTIAKYNADASRVYVMGTSSGGMMTNVMAATYPEVFEAGAAYSGVAHACFAGAASATPFSPNQTCARGLQHTPEEWGNFVRNSYPGYTGRRPRMQIYHGLADNLVYPRCAMEALKQWSNVLGVEFSRNVSGVPSQAYTQIVYGDGSKLVGYMGAGVGHVAPTNEQVMLKFFGLIN

SEQ ID NO: 30047 - protein, 242 aa, Neurospora crassa
  strain ATCC 24698 / 74-OR23-1A / CBS 708.71 / DSM 1257 / FGSC 987
MSTSTPTSTALIGSTGLVGSHILSTLLTSPTTSSQVQTISRRAPANPTNSSRLSPTVNADTSTWPTLLSSLVPLPTTVISSLGTTRVAAGGIANQWKIDHDLNVDLAKAAKQAGVKNFVFISSAGTRGALSTKVPYSQMKRGVEDTIQSLDFEHGIILRPGLILGEREKAQHAGQGLLYGLVRGLGRWVSLGVQDRFAQEAEVIARAAVKAAKMAEEGKAPGKWWVLEQDEIVKLGREEWKE

SEQ ID NO: 30048 - protein, 331 aa, Neurospora tetrasperma
  strain FGSC 2508 / ATCC MYA-4615 / P0657
MSPITLDLTSDFNPANTTGAGSSSSQPRTLLVAPPSVASHEERISALFSTYPRETTDLHMLDRLAAGLVTLPASTYDLILVLTDPDGSRHAEASALLSNRAVWSLLVPALKAGGNLRSEDGTLGTNTATPEAREAVLAGLVAGADGFTKPDYAEEEAVPLRFGLKRKTNPNPVVAPIQPVAQVVTAAPAGVGFVTLDLNDDLDLDDDDDDVIDEDTLLTEADLRRPIQQPPECQPKPGKKRRACKDCTCGLAERLEAEDKARRDKADQALNTLKLKSEDLLELDLTVPGKTGSCGSCALGDAFRCAGCPYLGLPPFKVGEEVSILNNVPQL

SEQ ID NO: 30049 - protein, 484 aa, Neurospora tetrasperma
  strain FGSC 2508 / ATCC MYA-4615 / P0657
MAAKKLLLAAALTASALAAPVLEGRQNCGSAWTQCGGIGWSGATCCSSGNSCVEINSYYSQCLPGAQVTTTAGASSTSPTSTSKVSSTTTKVTSSSAAQPITTTTAPSVPTTTVAGGASSTASFTGNPFLGVQGWANSYYSSEIYNHAIPSMTGSLAAQASAVAKVPTFQWLDRNVTVDTLMKSTLEEIRAANKAGANPPYAAHFVVYDLPDRDCAAAASNGEFSIANGGVANYKTYINAIRKLLIEYSDIRTILVIEPDSLANLVTNTNVAKCANAASAYKECTNYAITQLDLPHVAQYLDAGHGGWLGWPANIQPAATLFADIYKAAGKPKSVRGLVTNVSNYNGWSLSSAPSYTTPNPNYDEKKYIEAFSPLLNAAGFPAQFIVDTGRSGKQPTGQIEQGDWCNAIGTGFGVRPTTNTGSSLADAFVWVKPGGESDGTSDTSATRYDYHCGLSDALKPAPEAGQWFQAYFEQLLKNANPAF

SEQ ID NO: 30050 - protein, 354 aa, Neurospora tetrasperma
  strain FGSC 2508 / ATCC MYA-4615 / P0657
MARKSILTALAGASLVAAHGHVSKVIVNGVEYQNYDPTSFPYNSNPPTVIGWTIDQKDNGFVSPDAFDSGDIICHKSATPAGGHATVKAGDKISLQWDQWPESHKGPVIDYLAACDGDCESVDKTALKFFKIDGAGYDATNGWASDVLIKDGNSWVVEIPENIKPGNYVLRHEIIALHSAGQANGAQNYPQCFNLKVEGSGSTVPAGVAGTELYKATDAGILFDIYKNDISYPVPGPSLIAGASSSIAQSKMAATATASATLPGATGGSNSPATSAAAAAPAPSTTLVTSTKAAAPATSAAPAAPATSAAAGSGQVQAKQTKWGQCGGNGYTGATECESGSTCTKYNDWYSQCV

SEQ ID NO: 30051 - protein, 440 aa, Neurospora tetrasperma
  strain FGSC 2508 / ATCC MYA-4615 / P0657
MYSSSMLVALFALVNSLPGALGGFSSTATGNIAIYWGQNSANQVGGQQRLAYYCRNTNVNTIPLAFLNVIRDTEMNFSNAGDDCSIFPGTKLIKCTQIEEDIKTCQSLGKSILLSIGGATYSEGGFSSPAEAISWADRLWAMFGPVSNSDKRPFGTAVIDGFDFDFEAVAQNMVPFATRLRSLMDSAAATFGKKFLLSSAPQCPFPDRANNDLLQSVAFDFVSVQFYNNYCGVHTFQFGSPSQNNFNFGTWDNWAKTVSKNKDVKILLGVPGSSSAAGTGYIAGSQLANVIKYAQTFSSFGGVMMWDMSQVWANAGFLDSVASALGSTGGSGVGIIPTIETTSLPGSTTTSSTPVVQTATTWVTVTIWATATVNGPAATAKSTSTTTLWAESTTAISAPTPAAGLVNQWGQCGGNGYKGLTSCRAPYSCVKLSDWWSHCN

SEQ ID NO: 30052 - protein, 315 aa, Neurospora tetrasperma
  strain FGSC 2508 / ATCC MYA-4615 / P0657
MVRISLLTYLALGLGSTTVLADCGQAPSSSPSVQIPTGVLTPVTDFGVNPTGLDLHIYVPKDLAPKPAVILALHLCGGTGPIYSYLSNYNPHADERRSFVVLYPSTPHDNNCWDVASKKSLTRDAGGDTTSLANMVRWAISEFDADPAKVFVTGSSSGCMMSNVMAAAYPDIFSAVSCYSGIPAGCLAGSPGASPQNSDPTCGQGKMIKSGEEWAAVLKSIYGKPEGYTEGSYPKVQTWHGEADFFVNYPNLGEQLKQWSTVLDVPFSKTQANAPDTGYTKIVYGDGSKLVGYSAKGVGHTVPVHPEEDLKWFGL

SEQ ID NO: 30053 - protein, 312 aa, Neurospora tetrasperma
  strain FGSC 2508 / ATCC MYA-4615 / P0657
MKLLSFTTALLATLTAAHPVFDDLITPFTPLDYKRAPAASLRQISNFGSNPSNAKMYIYVPDNLAASPPIIVAIHYCTGTAQAYYTNSPYARLADQKGFIVIYPESPYSGTCWDVSSHATLTHNGGGNSNSIANMVDYTLKTYNGDATKVFVTGSSSGAMMTNVMAATYPALFAAGIVYSGVPAGCFYSQAGGTNAWNSSCANGQVNGTPQVWAKVVRDMYPGYEGARPKMEIYHGSADTTLNANNYNETIKQWAGVFGFDYLKPDTTQDNVPQSGYTTYTWGKGKLVGVYARGVGHSVPIRGSDDMEFFGL

SEQ ID NO: 30054 - protein, 659 aa, Neurospora tetrasperma
  strain FGSC 2508 / ATCC MYA-4615 / P0657
MIMEEAEEKRTTSSTWRPSRFSEWWSVHTTPRPPPPPSSPSPSPSPRGNCALQSYGKRLERGWRMQTRERGASNPPAKPTAPRSLARLHETGVANEPWGALRDINIYIIWGFGTSSNSFSSISQSSSSSTPFSLILTMLAKFAALAALVASANAQAVCSLTAETHPSLNWSKCTSSGCTNVAGSITVDANWRWTHITSGSTNCYSGNEWDTSLCSTNTDCATKCCVDGAEYSSTYGIQTSGNSLSLQFVTKGSYSTNIGSRTYLMNGADAYQGFELLGNEFTFDVDVSGTGCGLNGALYFVSMDLDGGKAKYTNNKAGAKYGTGYCDAQCPRDLKYINGVANVEGWTPSTNDANAGIGNHGTCCSEMDIWEANKVSTAFTPHPCTTIEQHMCEGDSCGGTYSDDRYGGTCDADGCDFNSYRMGNTTFYGEGKTVDTSSKFTVVTQFIKDSAGDLAEIKRFYVQNGKVIENSQSNIDGVSGNSITQSFCNAQKTAFGDIDDFNKKGGLKQMGKALAKPMVLVMSIWDDHAANMLWLDSTYPVEGGSPGAYRGECPTTSGVPADVEANAPNSKVIFSNIKFGPIGSTFSGGSSGTTPSNPSSSVKPVTSTAKPSSTSTASNPSGTGAAHWAQCGGIGFSGPTTCQSPYTCQKINDYYSQCV

SEQ ID NO: 30055 - protein, 414 aa, Neurospora tetrasperma
  strain FGSC 2508 / ATCC MYA-4615 / P0657
MREFMNYITNAFYGATGWNEDNKYNELNATSRGAILTVSVDLLHWYLETNTKTHELELIDFPLPRGLRLTLSSLATPHFATSYQLGSVGVVDGSISYLHSSIPLTHIAAQSDKIPLPALLRCYRRLHDLRSPGQQHYILDADPLSGLPPSPQSARALLGAASDAAVAGGALDGGSTDQDLGIYTHSLLYGRLYLPKSLLEGMIIKRFTQALQLQVRAVSEQSLRNGGTILGLVQYDKGKYGLEGLYSTDGGLLGFRGLYNFGGDASSSTCDPWTPTPGENNNNNNNNNNNNGNAQAGEKERIYGRFSVGGELYYGTLNKSGGMSLGARFATLPAHRGTPLTATLTINPLMGNINATKNDEYKGVLKARLDNNLRMGLLWEGRAKSLIFSIGTGIDLHKLGEPFRSLGLEVQYSS

SEQ ID NO: 30056 - protein, 97 aa, Neurospora tetrasperma
  strain FGSC 2508 / ATCC MYA-4615 / P0657
MQFTIATVLSLLTIAIAAPAAMERQVPYTPCSGLYGTAQCCATDVLGIADLDCANPPETVANATHFESTCADIGQRARCCVLPILGQDILCQTPAGL

SEQ ID NO: 30057 - protein, 342 aa, Neurospora tetrasperma
  strain FGSC 2508 / ATCC MYA-4615 / P0657
MRSTLLTGLIAGLLSQQAAAHATFQALWVDGADYGSQCARVPPSNSPVTDVTSNAMRCNAGTSPVAKKCPVKAGSTVTVEMHQSYPPVPTLTYKQQANDRSCSSEAIGGAHYGPVLVYMSKVSDAASADGSSGWFKIFEDTWAKKPSSSSGDDDFWGVKDLNSCCGKMQVKIPSDIPAGDYLLRAEVIALHTAASAGGAQLYMTCYQISVTGGGSATPATVSFPGAYKSSDPGILVDIHSAMSTYVAPGPAVYSGGSSKKAGSGCVGCESTCKVGSGPTGTASAVPVASTSAAAGGGGGGGSGGCSVAKYQQCGGTGYTGCTSCASGSTCSAVSPPYYYQCV

SEQ ID NO: 30058 - protein, 829 aa, Neurospora tetrasperma
  strain FGSC 2508 / ATCC MYA-4615 / P0657
MRTTSAFLSGLAAVASLLSPAFAQTAPKTFTHPDTGIVFNTWSASSSQTAGGFTLGMALPSNALTTDATEFIGYLECSSAKNGANSGWCGVSLRGAMTNNLLITAWPSDGEVYTNLMFATGYAMPKNYAGDAKITQIASSVNATHFTLVFRCQNCLSWDQDGVTGSISTSNKGAQLGWVQAFPSPGNPTCPTQITLSQHDNGMGQWGAAFDSNIANPSYTAWAAKATKTVTGSCSGPTTTSIAATPVPTGVSFDYIVVGGGAGGIPVADKLSESGKSVLLIEKGFASTGEHGGTLKPEWLQNTSLTRFDVPGLCNQIWVDSDGIACSDTDQMAGCVLGGGTAINAGLWYKPYTKDWDYLFPSGWKGSDIADATSRALSRIPGTTTPSQDGKRYLQQGFEVLASGLKASGWKEVDSLKDSEQKNRTFSHTSYMYINGERGGPLATYLVSAKKRSNFKLWLNTAVKRVIREGGHITGVEVEAFRNGGYSGIIPVTNTTGRVVLSAGTFGSAKILLRSGIGPKDQLEVVKASADGPTMVSNSSWIDLPVGHNLVDHTNTDTVIQHNNVTFYDFYKAWDNPNTTDMNLYLNGRSGIFAQAAPNIGPLFWEEITGADGIVRQLHWTARVEGSFETPDGYAMTMSQYLGRGATSRGRMTLSPTLNTVVSDLPYLKDPNDKAAVVQGIVNLQKALANVKGLTWAYPSANQTAADFVDKQPVTYQSRRSNHWMGTNKMGTDDGRSGGTAVVDTNTRVYGTDNLYVVDASIFPGVPTTNPTAYIVVAAEHAAAKILAQPANEAVPRWGWCGGPTYTGSQTCQAPYKCEKQNDWYWQCV

SEQ ID NO: 30059 - protein, 586 aa, Neurospora tetrasperma
  strain FGSC 2508 / ATCC MYA-4615 / P0657
MAFNFNWSPLTADAGFYERARDLLTTALNKSPKPPIIVDDIFVTELNLGSVPPDLEILEIGDLAEDRFRGIFKMCYSGDAFLTLATRVQANPLNTYISAKPSFTSPEPLTASSSLTIPLQITLSEIKLSAFIILVFSKQKGLTIVFRNDPLESLKVSSTFDSIQFVRDYLQKTIEMKLRDLIMDELPAIIHRLSLQLWCPDQVPKEDEEAKEESDAAINPLATPPLDAVDAHGHRLDPAEISSLSLDGGPETQSLFSQKNLEKMDALARAHRTSSLLTPNILEVVFRAWAGQSDKPDATATPASTPNLHRTSSYQGSVHTYTFSDNSSQASGHALSRPTLVSMGSATTGLSLGSGRHSKAGRKKKMRVVNLRSKTAASEPVSEIGSTSSQAGDSHSEASTRTPMSEPVIPTTIREVPEDDLAASQSKVRFRPPTDATTSARASESSGPRAAVPSVPVTAQPSRAASPQEHVYTRQPSMFPSSPAPQTSAQEMPPSYSSRVSEKAESTASIYADAKGQQQQFQQQQQQQWGRAGPQPDMSSVILEQAWITKIAGEIARRVYDEKNRNPAFWEESHQHDIPPPAYEPR

SEQ ID NO: 30060 - protein, 671 aa, Neurospora tetrasperma
  strain FGSC 2508 / ATCC MYA-4615 / P0657
MAFSQFQPIGALTGVSFGISSSKVLRLADENGPEPPKDSTVLLPTMTTIVKIMFDILIIGAGPSGLCAAKTFLQHNPTSNIVILDSHSTIGGVWSKERLYPTLRTNNLYPTMDFSDFPMKGVGIGRPGHHITGEEMHAYLTACAHHFDLMKRIRFNTRAVRVHQVQEAAPTSDDGWKVDVHELGNPTTTTTLKAKKLVMATGILGVPNMPSLKGSETFDAPLLHSSALGPRYQDVLQNPHINRVAVLGGSKSAYDTVYLAATTGHKVDWIIRKSGRGPSWVFPSHTKIGPFKAWREKLVTRRIFTFMSPCVLPDHSGKHISWIRDFLHTNKVGKAITKRFWKILHADTIRDCRYREEKEDKNFSVLEPDHSPFWYGTSSGTLNYEQDFKALVTSGQVTVHRQDISHLSPHTIHFFADNNETTSLTAIDALICATGYSPQPPIDFFPPELHFQLGIPTTTDSLSDEEKAIWATYDQEADEVITKRFPQLIPPPPSIPTLTPTSVLCSPKTQESKQYTPWRLHRGIAPPTLTTSHTRNSLVFLSMHSNITNIPRIELQCLWSLAYFNDKLKVSPLQQVLYKDTALFQRWCQLRSPLGHGRQYPDLNFDQLPYWDWLVADLGLKVRRKKSVWRELVSPYGSEDYRGLVGEWIEKYGIDKGEGSDQNRREGEKRL

SEQ ID NO: 30061 - protein, 292 aa, Neurospora tetrasperma
  strain FGSC 2508 / ATCC MYA-4615 / P0657
MLPKTLLGLALTAATGLCASLQQVTNWGSNPTNIQMYTYVPDKLATKPAIIVALHGCGGTAPSWYSGTRLPSYADQYGFILIYPGTPNMSNCWGVNDPASLTHGAGGDSLGIVAMVNYTIAKYNADASRVYVMGTSSGGMMTNVMAATYPEVFEAGAAYSGVAHACFAGAASATPFSPNQTCARGLQHTAEEWGNFVRNSYPGYTGRRPRMQIYHGLADNLVYPRCAMEALKQWSNVLGVEFSRNVSGVPSQAYTQIVYGDGSKLVGYMGAGVGHVAPTNEQVMLKFFGLIN

SEQ ID NO: 30062 - protein, 355 aa, Neurospora tetrasperma
  strain FGSC 2508 / ATCC MYA-4615 / P0657
MKFTLLSGLVAKALSVSAGSILWDGRFNDLTSATDLSKWSWSSQVGPYQYYIHGPSEVTSYVNLSPSFKNPADSGSSQGAKITLDKTAFWNGQTMRRTELIPQTTAAINKGKVFYHFSLMRKDTNAPALTREHQIAFFESHFTELKSGWQSGASGTSDPLLRWCIGGQTKWSVNWDADVWHNVAYEIDFDANTVGFWHSTGSDALTQVIAPQAAGTSSNGADWHVGVLELPRDGYADATEDFYFSGVYIESGSITTSVAGPGTAAPVKPSTSSASSSTTVAAVTSASAAPAVTTSKAGTKTCTRKSSAAPAATTSAGSCTAARYAQCGGKGFSGCTACASPYKCNLVNDWYSQCY

SEQ ID NO: 30063 - protein, 252 aa, Neurospora tetrasperma
  strain FGSC 2508 / ATCC MYA-4615 / P0657
MSLNMKSLSLLAVASLASAGATNTNLQTTFPTPSGTTALPAVKTIAAGGSFDGGMYQWDRWPSTCNQQSEGGDKDAVFILEDGATLSNVVIGPNNGEGVHCMGRCTLNNIWWTDVCEDAATFKQSSGTSYVNGGGARHASDKVLQHNGGGTVAVKNFYATDIGKLYRSCGNCKTQHQRSSTFTNVYVEGAKVVAGVNANYGDKTTIKNSCIKDSSVCWLYKGTSNNSEEPKKIGSGPSGTACAVAALKTSGC

SEQ ID NO: 30064 - protein, 514 aa, Neurospora tetrasperma
  strain FGSC 2508 / ATCC MYA-4615 / P0657
MEERKQKVVVVGAGPVGSLAALYAANRGHDVEIYELRGDLRDPSTTPLNFTRSINLALSERGLKAMRHANQPRLIDYVKGVTIPMRGRMIHGKRPDGKLYEEAQDYDIHGRSILAIDRGDLNKRLLDMLEEMPNVTFFFNHKLTGADFKRNKAWFEDRDESTSNPRDRAREIEVDFDFMIGADGAHSAVRYHLMKFSRMDYQQEYIDTLWCEFQIAPSSSAKSKFRISPNHLHIWPGKEFMFIAIPSNDGSFTCTLFAPAAIYEQLEEAASTTTGGTSSSSIPDFFDKHFPGVTSLITPADLVSQFQTNPHLPLISIKCKPYHFSSSVVIVGDAAHAMVPFYGQGMNAGLEDVRILFDILDKHDRMTNDDSSLEASQRELALAEYSAVRVADAHAINDLALQNYIEMRSSVLSPVYRWRKALEEWLSVYVPSLGWQTKYSRVSFGNERYSEVVKKSERQGQVLLRSLVGGVGLPMLAGGLFLWFRYKGALGRAAYGVFYNFMGMVCRTIHGRRR

SEQ ID NO: 30065 - protein, 421 aa, Neurospora tetrasperma
  strain FGSC 2508 / ATCC MYA-4615 / P0657
MVGLKNVALFAASIILPASITWAAPIIEVETKPIPEKYIVLLKPHADLEGHLSWAKDVHARSLSRRDTAGVHKAWSVGSKFKAYAGEFDEETLKIIQRDERNVHSIEPDKSWRLYKSNKKDNDDSNSDNTTIITQKQAPWGLGYLSHKGKTSSDYVYNSTAGTGTYAYVVDTGCWKDHVDFEGRVHLGYNAYPDSPFIDMDGHGTHVTGTLISKTYGVAKNATVICVKVFHGGGSANTIVMDGFEWAVKDIIAKKRQRNSVINMSLGCDRSEAFNAIVDAAYDQGILTVVAAGNENQPAALVSPASSARAFSVGAIDNKNTRAYFSNYGAIVDIFAPGVNIVSTYIGKKDGDNNRTMTMSGTSMASPHVAGLALYLKSLDPEKYGNSSDAHSGLKALGVPDKVWDAGEMSPNLVAYNGVQG

SEQ ID NO: 30066 - protein, 378 aa, Neurospora tetrasperma
  strain FGSC 2508 / ATCC MYA-4615 / P0657
MAALKLGFMALAPALAAAADIPLWGQCGGIGWQSAGSACTSVATCTSFNDYYCCSKPVTVSATPTTTNRGSSSTFSTSIKPSSSSTESTGSSTQSSSVPVPTSTSAKYLISFGDSYSQTGFDINGSKPSSSNPLGNPPLPGWTASGGLNWVGFLASQLNTSLTLSYNFASGGATTNASLVAPYAPTVLSFVDQVAQFSGSIASRPAYAPWNSENSLVAVWIGVNDVGNSWWMSDSEMDALYGQIMDSYFGRLQVLYDAGARNFALLGAAPIYYTPSTIGQGATTVATQKVAIAKYNSLLASRFDAFLEVNTDVTGKLVDTVAPFEKAIKNPTAYGAPDATCFNEDGVSCLWFNDYHPGVQIQKLVAQAVKSAFTGTFF

SEQ ID NO: 30067 - protein, 364 aa, Neurospora tetrasperma
  strain FGSC 2508 / ATCC MYA-4615 / P0657
MAASIPSTSGNHIKASSSCTFSGSTGFDLLSKGLSSCQEIVISDLQVPAGKTLTLDKLNPGTTVTFAGNTTFPYLSSGWAGPLLSISSSSKLTIRGLSSSVLYGSGEKYWDGLGQKGPIKKPKFFQVHNLEDSVIEGVTILNAPVQVMSINGCKNLTVTGFTLDNKAGDGDWNAGKGGRNTDAFDIGSSSNVVIDGAKVYNQDDCVAINSGTDITFRNGLCSGGHGLSIGSVGGRSDNTVKNVLFENSVIANSENGARIKTNYGTTGLVSNITYRNVKLQNITKYGIMVDQSYGSSSKNASPTNGVPITGFTLSNVTGNVLSSGTNIFINCGDGSCKQFEWNQVDIKGGKKSSKCLRVPSGAWC

SEQ ID NO: 30068 - protein, 419 aa, Neurospora tetrasperma
  strain FGSC 2508 / ATCC MYA-4615 / P0657
MVTMSTWPWGLLVTTGYLLNLTFAAHPLTTDANCHCYKTNATSTNYFRQHKFFDFRNLQQYANTPPNPISTFEGNAAAPPTSSYFDSNQWKDNWGIQTWNNTELMRLNNTDVNDATVPMINSFNNIYIERSSDRNANGQTYLVMRTVRHSLDGPSTRYGSNSSSGFQSSAEFESKLTSYQFLSLRMLARTRGSPGAVTAMFTYRPPPQPQQLALVQEADLEIRTQDPPNFVQYTNQPAWNSTSDIKEATRNASMPSGKKWSDWAFYRMDWTPGQSTWFVNGVEASKINFQAPRDPSQVMFNVWSDGGSWSGIMGQGGKAEMQVQWIEMVYNSTEVSGPVTGPWGDKKGCANICSIDETTQLGTPVLISNPNGGNTPANPPNSCTTVKYGQCNGKNWNGCKTCASGSACRYQNDYYSQCL

SEQ ID NO: 30069 - protein, 841 aa, Neurospora tetrasperma
  strain FGSC 2508 / ATCC MYA-4615 / P0657
MKSISVIQLLLAAAAAPVRAAASWKNVNIGGGGGFVPGFVFHPTEKGVAYARTDIGGLYRLNADDSWTAITDSITTDDKWNNWGIDAVALDPQDPDKVYAATGMYTNSWDPNNGTLIRSSDRGATWSSTELPFKVGGNMPGRGMGERLAVDPKNSKIIYFGARSGHGLYKSTDGGVTFSKVSSFTAVGDYVVDPSDTTGLNNDKQGIAFVTFDSTSATTNGATSRIFVGSATNSTSSVWVSNDAGATWSAVAGQPGTYFPHKCKLQPTEKALYLTYSDGTGPYDGTAGAVYRYDITNGTWKDITPVSGSDLAYGFGGLGVDMKNPGTIMVASLNLWWPDAQIYRSTDSGATWSPIWEWDGYPNMNQYYGLTTPNAPWIETGFLSQDTKHLGWMIESLEINPLDSDHWLYATGLTVYGGHDLTKWDTVHNVTIQSLAVGIEEMAVLGLASAPGGSELLAAVGDDCGFTFKASSDLGTSPKTPWMTPQWASSADVDYAGNKPANVVRIGSGSGAQQVAVSSDGGASWHAHNGTDTTKSSGTVAYSADADTIVWSSGTSGVVRSQNQGTFTAVASLPSGAVIASDKRNNTVFYAGSTTGTFYRSTDTGATFTAVSDALGSAEAVRDIIAHPTVAGELYVSTDAGIFRSTDFGVSFTKLSGLTNTQSISLGVGSASGSWNLYAFGTGANGNKLYASADAGATWTDVQGAQGFGSIAVASSKVLGSGNVAGQVYVGTNGRGVLYAQVSVSGTVPDATSSSSAPVKTSSTAAAAPSSSAAVKTSSTSYAAPPTTATLTLSSVKTTSTVGAELAQHWYQCGGVGWTGPTACVSPYKCEKQNDYYSQCV

SEQ ID NO: 30070 - protein, 299 aa, Neurospora tetrasperma
  strain FGSC 2508 / ATCC MYA-4615 / P0657
MWPSPKAAYLLLLARSALVGASPVELEERQSCPSIHVFGARETTVSPGFGTAGVVVNLILQAYPGATSEAIVYPACGGQSSCGGVQYGDSARQGTDAVATAVNSLNARCPDTQIVLVGYSQGGQIMDNAVCGGPDSGAGITTSTPGINASALNQVKAVIMMGNPRYRAGLSYNVGTCTAYGFDPRPAGYTCASASKLQNYCDSPDPYCCTGNDAATHQGYGSKYGQQALAFVKSKLSSGGGGGGSTPTNPSNPSTPTTPSTGNCAAKWGQCGGQGWTGATCCQSGSTCQAANQWYSQCV

SEQ ID NO: 30071 - protein, 293 aa, Neurospora tetrasperma
  strain FGSC 2508 / ATCC MYA-4615 / P0657
MRSSTVLQTGLVAALPFAVHAASGSGQSTRYWDCCKPSCSWSGKASVNRPVLACDANNNPLSDASVKSGCDGGSAYTCANNSPWAVNDQLAYGFAATKLSGGTESSWCCACYALTFTSGPVAGKTLVVQSTSTGGDLGSNHFDINMPGGGVGLFDGCTRQFGGLPGAQYGGISSRSQCDSFPAALKPGCQWRFDWFQNADNPNFTFKQVQCPSELTSRTGCKRNDDSQFPVFTAPSGGGTNPSTPTTPPSSGGGSGCTADKYAQCGGSGWSGCTNCPSGSTCKTINDYYHQCA

SEQ ID NO: 30072 - protein, 427 aa, Neurospora tetrasperma
  strain FGSC 2508 / ATCC MYA-4615 / P0657
MHLPTVLSVIFAAAGVTAQLNDLAVAAGLKYFGTAGQEGTITSDTTYRDIINNVHEFGQLTPENGMKWDATEGQPGKFTFTSGDIVAGVAKSNGQLLRCHTLVWYSQLPSWVSNGSWNRDTLQSVIESHISNVMGHYKGQCYAWDVVNEAISDDAQGNYRDSIFFKTFQTDYFPIAFNAAKKADPNAKLYYNDYNLEYNGAKTERALELVKLIKAAGAPIDGVGFQAHMTVGGTPSRTAMATLLKRFTALGVEVAYTELDIAHKNTASSSSVQAQQATDYANMVGSCVDVDGCVGVTIWGFIDKYNWIQNGNAAIFDSNFNKKPAYSAISSVLAAAATKAPTTAKNTNAAAAVPTTLRTAIATASACDATATATKATAAPAKSATGTATGAQQARWAQCGGNGYTGPTACQAPYTCKVQNAWYSQCL

SEQ ID NO: 30073 - protein, 303 aa, Neurospora tetrasperma
  strain FGSC 2508 / ATCC MYA-4615 / P0657
MRFHTITSLSTTFTTIFTILTFNHVLPVQAKPQQQPSKASIFHVRHIDNLNLNTHLPKPTPPAKFLLQHAKEPITITISTITITITATTTPSNTPASSSAPSFLNPALFTSALLNSTNFYRAQHNASAVIYNDTLSSFASHYLDKLGLPSSSSSSSSSSSKSKSKSSSTTTKCELTHSHGPYGENLALGCSDVQSCVEMWGDERAKYDFGSQAKFGEDTGHFTQLVWKDTTDVGCAARWCQGWNAGRGGWYLVCEYWPRGNVVGEFGSMVQRRVAGNGGGSRVEAEWRVMVGVVVVGGWMVFG

SEQ ID NO: 30074 - protein, 628 aa, Neurospora tetrasperma
  strain FGSC 2508 / ATCC MYA-4615 / P0657
MSTVRICVCGDEGTGKSSLIASLVKGVFVANKIQAVLPQVTIPPTTGTPENVTTTIVDTSARPQDRTTLRKEIRKSNVILLVYSDHYSYERVALFWMPYFRSLGVNVPVVLCANKSDLVSDGNAAQVAEEEMLPVMAEFREIDSCIRTSAKEQKNVIEVFYLCQKAVTHPIAPLFDYKEGQLKPACVDALRRIFFLSDKDQDGCLNDQEMQDFQQKSFDKPLSQEDLDNIKLTVSKSVPSSSTDKGLDLRGFLQLNKLYAEKGRHETIWIILRKYHYTDSLSLEDSFLHPRFDVPDYASAELSPAGYRFFMDLFLTFDKDNDGGLNDRELAALFAPTPGLPHSWAETSFPSTTVRNEAGHITLQGWLAQWSMTTFLEPKTTLEYLAYLGFETPNARETTTAALKITKPRKRRRRPGRVDRNVVLCYILGSSGAGKSSLLDVFLNRPFDTLYHPTIKPRQAVNSVELQGGKQCYLILEELGELEPAILENQAKLDACDLICYAYDSSEPDSFSHIVELRKRYPQLDELPAVYTALKADRDKTTQRSELQPDAYTAALNMSAPLHVSVTWNSISELFVALAEAATNPSTAFPRSEEPPADRASLYMALGATACAALAAFMIWRRSTSNAA

SEQ ID NO: 30075 - protein, 390 aa, Neurospora tetrasperma
  strain FGSC 2508 / ATCC MYA-4615 / P0657
MKATILASTFAAGALAQNGAWGQCGGNGWSGTTSCISGYSCNYVNDWYSQCQPGTAAPTTTAAATTLVTSTKTAPPATTTTATASGKFKWFGVNEAGGEFGDGIFPGRWGTEFTFPDTNTIQTLRSQGYNIFRVGFAMERLVPNTLTSSFDNGYLTNLTQVVNSVTNSGAYIVLDPHNYGRYYGKIITDTAAFKTFWQNVAAKFASNSKVIFDTNNEYNTMDQTLVLNLNQAAIDGIRAAGATSQYIFVEGNQWTGAWSWNVTNTNLAALTDPENKIVYEMHQYLDSDSSGTSTSCVSSEIGVQRIVGATAWLRANGKKGVLGEFAGGANSVCKAAVTGLLEHLKANTDVWEGALWWAAGPWWGDYMYSFEPPSGTGYTYYNSLLKTYTP

SEQ ID NO: 30076 - protein, 294 aa, Neurospora tetrasperma
  strain FGSC 2508 / ATCC MYA-4615 / P0657
MKLSVAAALSLAASEASAHYIFQQVGAGTSVNPVWKYIRKHTNYNSPVTDLTSKDLVCNVGASAEGVETLSVAAGSQVTFKTDTAVYHQGPTSVYLSKADGSLSSYDGSGGWFKIKDWGATFPGGEWTLSDTYTFTIPSCIPSGDYLLRIQQIGIHNPWPAGVPQFYLSCAHISVTGGGSASPATVSIPGAFKETDPGYTVNIYSNFNNYTVPGPEVFTCSGSGSGSGSGSGSTTPPSQPTTSTTLPTSTIPTSPSGCTVAKYGQCGGIGYSGCTSCASGSTCKIGNDYYSQCL

SEQ ID NO: 30077 - protein, 836 aa, Neurospora tetrasperma
  strain FGSC 2508 / ATCC MYA-4615 / P0657
MRVSWGLLAFPAAVSAIENGINGWLRYAPLPNDQRPPNLLLPGAIMALSTNKTSPVYTAGQELQAGIKSILNQTLPLYHEPDKWLGSTILVATTGQFHGVKPAATLADDGYLLRVRPGNVVILGQTERGALYGAFDYLSRIAQGRFSDADLIANPDAPIRWVNQWDNMDGSIERGYAGASIFFRNNTIPKDLNRVSQYARLLASIGINGIVVNNVNANANLLTDANIDGLGRIADAMRPYGVQIGISLNFVSPQTLGGLLTFDPLDQSVISWWTDKTNCLYRRIPDMAGYLVKANSEGQAGPLTYNRTLADGANLFAKAVQPHGGIVMFRAFVYDNHINPADLKADRAKHAVEFFKGLDGQFLDNVVVQIKYGPIDFQVREPASPLFANIPQTNTAIELQITQEYLGQQSHLVYIAPLWKTILDFDLRADDQPSLVRDVVAGRRFSNKRGGYAGVVNVGTNTTWLGSHLAMSNLYAYGRLAWDPNQDPQALLEDWTRLTFGSDPLVLGVVTEISMASWPAYENYTGNLGIQTLTDILYTHYGPNPASQDNNGWGQWTRADHDGIGMDRTVSTGTGFSGQYPAEVAEKFESIETTPDDLLLWFHHVNYTHVLKSGKSVIQHFYDAHYAGAETAQTFPIAWESLRNKIDTERFNDVLFRLRYQAGHSIVWRDSICQFYYNLSGIPDGTGRVGRHEYRIEAETMALKNYKLTGVNPVETASNLTAVVLVSNHTSGEATTKLNFDSGKYDVAINYFDLIGGKAHYKAFLNGKLLLKWAGDLEDKLGHTFSTKLDGHSATRVTIRDIQIQKGDVLKITGVAEGNELAPLDYIAVLPQGVVD

SEQ ID NO: 30078 - protein, 332 aa, Neurospora tetrasperma
  strain FGSC 2508 / ATCC MYA-4615 / P0657
MKSSLILAASGALMASASPILQDRRVHFTTKVVEEWVTVTVTAGGVPFATVNAFHEHGPGRPVYSAHPQAASAATVQPTSQAPAPVPTPSSSSIVVVAPPPAPETTSSTVIIVPVSSSTQQPAPTTAPAVVAAPPATTSTMQERASTKVDSPAAPSGSDYASTLLYHHNIHRSNHSAGAMTWGETYANYAQQAAASCVFQHDLTPGGGGYGQNIAMWGSSDKQTVQDVGAVKAGAQATTNMWYNGELSLWPASDYGKANPDMSNFEGWGHFSQLVWKESKELGCYTQFCPQGTMSSQMDVWYTVCNYYPAGNMGGEYGKNVSPPLNEALVVA

SEQ ID NO: 30079 - protein, 344 aa, Neurospora tetrasperma
  strain FGSC 2508 / ATCC MYA-4615 / P0657
MKSSLLVVLTAGLAARDAIAHAIFQQLWVDGVDYGSTCNRLPTSNSPVTNVGSRDLVCNAGTRGVSGKCPVKAGGTVTVEMHQQPGDRSCNSEAIGGAHWGPVQIYLSKVSDASTADGSSGGWFKIFSDAWSKNSGGRVGDDDNWGTRDLNACCGRMDVPIPKDLPSGDYLLRAEALALHTAGQSGGAQFYMSCYQITVSGGGSANYATVKFPGAYRASDPGIQINIHAVVSNYVAPGPAVVAGGVTKQAGSGCTGCESTCKVGSSPSAVAPGGNPVSGGSDGNAPEVGEPSGGEGSPSAPGACAVAAYGQCGGDGYSGCTQCASGYTCKAVSPPYYSQCAPTS

SEQ ID NO: 30080 - protein, 359 aa, Neurospora tetrasperma
  strain FGSC 2508 / ATCC MYA-4615 / P0657
MKTGSILAALVASASAHTIFQKVSVNGADQGQLKGIRAPANNNPVTDVMSSDIICNAVTMKDSNVLTVPAGAKVGHWWGHEIGGASGPNDADNPIAASHKGPIIVYLTKVDNAATTGTSGLKWFKVAEAGLSNGKWAVDDLIANDGWSYFNMPTCIAPGQYLMRAEIIALHNAGSQAGAQFYIGCAQINVTGGGSTSPSNTVSFPGAYSASDPGILINIYGGSGKTDNGGKPYQIPGPALFTCPAGGSGGSSPAPATTASTPKPTSASAPKPTSTTASTPKPTNGSDSGTGAAHSGQCGGSKPASTTKASTPQPTNGGNSAVRAAALYGQCGGKGWTGPTTCASGTCKFSNDWYSQCLP

SEQ ID NO: 30081 - protein, 666 aa, Neurospora tetrasperma
  strain FGSC 2508 / ATCC MYA-4615 / P0657
MSIDLNWDTVTGGPDGQELAHKIRDFIHEKFQAVPLPRFIKSVTVHDFEFGSIPPEIELKDITDPLPDFYEEQPGIDSSEESDSEEEVAYENEGEYLDDPVEQQYGRLRGASASESRRRLTVNSSTGSRNGSGPNSGRVAYLPPHLNPHYSGGSGNNSSQSLDRDGRYYRDPNTAGLGGPAHGTNHHHADLGSPFLGVSTPGIPGGTSNLNLHYFTSQFTAGLSGTQTPLAAVAGAAHQRGPSWIADQQQQQQNNILPGAGGGGAGGMGGPVAAAAAAAATTQGLHSSSTPNLRLHFPGVGTGKNAPGPSPLTGTSTPLGTLGTAGGVGGIGRGMGMAGMGSMASMGYPPTAPVLAIPTGPRHKRNPSSQSLNSVGDYSPVAPAPAERQGLFSAAAASPPSSTPSPAVGLGIGGRGIGAAGAGAGALATSGPRLQIPKQGLREKHSVSTLAPNSAGTSNNRAGSAILDDDDGFLDGMHDHRDHPAQQLEPEEDEEEEEEGEEERQRFREPRVEDIQAVFRIKYAGDVKLLLTADILLDYPMPSFVGIPVRLSITGLTFDGVGVVANIRKRVHFCFLSPEDAVAAVGGEENKAAGSGNGSGIGGSDGAKTKMGGLLQEIRVESEIGQRESGKQSLKNVGKVERFVLEQVRRIFEEEFVYPSFWTFLV

SEQ ID NO: 30082 - protein, 392 aa, Neurospora tetrasperma
  strain FGSC 2508 / ATCC MYA-4615 / P0657
MKFSSFASGLLALGASLASAAEVVKRASLQQVANFGSNPSGVKMYLYVPNKLATKPAIIVAIHYCSGTAQAFYQGTQYAQLAEKYGYIVIYPESPYKGTCWDVSSPASLTHNGGGNSNSIANMVTYTIKQYGADASKVFVTGTSSGAMMTNVMAATYPELFAAASVYSGISAGCFATGTVNGWNSTCSQGHSIHSQQEWANVVFNMYPGYEGPRPRMMIHHGSADTTLYPQNFNETLKQWAGVFGYTYGQPQQTLSNQPASGWTKYVYGPNLVGAYGTGITHATPMFPQDDLEWFGITGNNNASPSKAAPPATTHAAAVAAPTTTLLACVRPSTAPATPSSAAPAAPAAPASKGGCTVQRWGQCGGNGYTGCTACASSTTCKKMNDWYSQCV

SEQ ID NO: 30083 - protein, 365 aa, Neurospora tetrasperma
  strain FGSC 2509 / P0656
MKTGSILAALVASASAHTIFQKVSVNGADQGQLKGIRAPANNNPVTDVMSSDIICNAVTMKDSNVLTVPAGAKVGHWWGHEIGGAAGPNDADNPIAASHKGPIIVYLAKVDNAATTGTSGLKWFKVAEAGLSNGKWAVDDLIANDGWSYFNMPTCIAPGQYLMRAELIALHNAGSQAGAQFYIGCAQINVTGGGSASPSNTVSFPGAYSASDPGILINIYGGSGTTDNGGKPYQIPGPALFTCPAGGSGGSSPALATTASTPKPTSASAPKPTSATASTPKPTNGSGSGTGAAHSGQCDGSKPASTTKASTPQPTNGGNSAVRAAALYGQCGGKGWTGPTSCASGTCKFSNDWIFDYNYTLIRPY

SEQ ID NO: 30084 - protein, 343 aa, Neurospora tetrasperma
  strain FGSC 2509 / P0656
MKSSLLAVLTAGLAVRDAIAHAIFQQLWVDGVDYGSTCNRLPTSNSPVTNVGSRDVVCNAGTRGVSGKCPVKAGGTVTVEMHQQPGDRSCKSEAIGGAHWGPVQIYLSKVSDASTADGSSGGWFKIFSDAWSKKSGGRVGDDDNWGTRYLNACCGRMDVPIPKDLPSGDYLLRAEALALHTAGQSGGAQVYISCYQITVSGGGSANYATVKFPGAYRASDPGIQINIHAVVSNYVAPGPAVAAGGVTKQAGSGCTGCESTCKVGSSPSAVAPGGKPASGGSDGNAPEVGEPNGEGSPSAPGACAVAAYGQCGGDGYSGCSQCAGGYTCKAVSPPYYSQCAPTS

SEQ ID NO: 30085 - protein, 667 aa, Neurospora tetrasperma
  strain FGSC 2509 / P0656
MSIDLNWDTVTGGPDGQELAHKIRDFIHEKFQAVPLPRFIKSVTVHDFEFGSIPPEIELKDITDPLPDFYEEQPGIDSSEESDSEEEVAYENEGEYLDDPVEQQYGRLRGASASESRRRLTVNSSTGSRNGSGPNSGRVAYLPPHLNPHYSGGSGNNSSQSLDRDGRYYRDPNTAGLGGPAHGTNHHHADLGSPFLGVSTPGIPGGTSNLNLHYFTSQFTAGLSGTQTPLAAVAGAAHQRGPSWIADQQQQQQNNILPGAGGGGAGGMGGPVAAAAAAAAATTQGLHSSSTPNLRLHFPGVGTGKNAPGPSPLTGTSTPLGTLGTAGGVGGIGRGMGMAGMGSMASMGYPPTAPVLAIPTGPRHKRNPSSQSLNSVGDYSPVAPAPAERQGLFSAAAASPPSSTPSPAVGLGIGGRGIGAAGAGAGALATSGPRLQIPKQGLREKHSVSTLAPNSAGTSNNRAGSAILDDDDGFLDGMHDHRDHPAQQLEPEEDEEEEEEGEEERQRFREPRVEDIQAVFRIKYAGDVKLLLTADILLDYPMPSFVGIPVRLSITGLTFDGVGVVANIRKRVHFCFLSPEDAVAAVGGEENKAAGSGNGSGIGGSDGAKTKMGGLLQEIRVESEIGQRESGKQSLKNVGKVERFVLEQVRRIFEEEFVYPSFWTFLV

SEQ ID NO: 30086 - protein, 399 aa, Neurospora tetrasperma
  strain FGSC 2509 / P0656
MKFSSFASGLLALGASLASAAEVVKRASLQQVANFGSNPSGVKMYLHVPNTLATNPAIIVAIHYCSGTAQAFYQGTQYAQLAEKYGYIVSAGLLVIYPESPYEGTCWDVSSPASLTHNGGGNSNSIANMVTYTIKQYGADASKVFVTGTSSGAMMTNVLAATYPELFAAASVYSGVSAGCFATGTVNGWNSTCSQGHSIHTQQEWANVVFNMYPGYEGARPRMLIHHGSADTTLYPQNFNETLKQWAGVFGYTYGQPQQTLSNQPASGWTKYVYGPNLVGAYGTGITHATPMFPEDDLEWFGITGNNNNNNNNNASPSSKAAAPTTTHAAAVAAPTTTLLASVRTSTAPATPSSTAPASKGGCTVQRWGQCGGNGYTGCTACASSTTCKKMNDWYSQCV

SEQ ID NO: 30087 - protein, 390 aa, Neurospora tetrasperma
  strain FGSC 2509 / P0656
MKATILASTFAAGALAQSGAWGQCGGNGWSGATSCISGHTCTYVNDWYSQCQPGTAAPTTTAAATTLVTSTKTAPPATTTTATASGKFKWFGVNEAGGEFGDGIFPGRWGTEFTFPDTNTIQTLRSQGYNIFRVGFAMERLVPNTMTSSFDNGYLTNLTQVVNSVTNSGAYIVLDPHNYGRYYGEIITDTDAFKTFWQNVAAKFASNSKVIFDTNNEYNTMDQTLVLNLNQAAIDGIRAAGATSQYIFVEGNQWTGAWSWNVTNTNLAALTDPENKIVYEMHQYLDSDSSGTSTACVSSEIGVQRIVGATAWLRANGKKGVLGEFAGGANSVCKAAVTGLLEHLKANSDVWEGALWWAAGPWWGDYMYSFEPPSGTGYTYYNSLLKTYTP

SEQ ID NO: 30088 - protein, 291 aa, Neurospora tetrasperma
  strain FGSC 2509 / P0656
MKLSVAAALSLAASEASAHYIFQQVGTGTSVNPVWKYIRKHTNYNSPVTDLTSKDLVCNVGASADGVETLSVAAGSQVTFKTDTAVYHQGPTSVYLSKADGSLSSYDGSGGWFKIKDWGATFPGGEWTLSDTYTFTIPSCIPSGDYLLRIQQIGIHNPWPAGVPQFYLSCAHISVTGGGSASPATVSIPGAFKETDPGYTVNIYSNFNNYTVPGPEVFTCSGSGSGSGNGSTPPSSQPTTSTLPTSSTPTSPSGCTVAKYGQCGGIGYSGCTSCASGSTCKVGNDYYSQCL

SEQ ID NO: 30089 - protein, 863 aa, Neurospora tetrasperma
  strain FGSC 2509 / P0656
MLLPHISMRMISAKHSRHWSRPDQHWYRTRCGFPGAFPAAASAIENGINGWLRYAPLPNDQRPPNLRLPGAIMALSTNKTSPVYTAGQELQAGIKSILNQTLPLYHEPDKWLGSTILVATTGQSHGVKPATTLADDGYLLRVRPGNVVILGQTERGALYGAFDYLSRIAQGRFSDADLIANPDAPIRWVNQWDNMDGSIERGYAGASIFFHNNTISKNLNRVSQYARLLASIGINGIIVNNVNANANLLTDANIDGLGRIADAMRPYGVQIGISLNFASPQTLGGLSTFDPLDQSVISWWTDKTNRLYKRIPDMAGYLVKANSEGQAGPLTYNRTLADGANLFAKAVQPHGGIVMFRAFVYDNHINPADLKADRANHAVEFFKGLDGQFLDNVVVQIKYGPIDFQVREPASPLFANIPQTNTAIELQITQEYLGQQSHLVYVAPLWKTILDFDLRAGDQPSLVRDVVAGRRFSNKRGGYAGVVNVGTNTTWLGSHLAMSNLYAYGRLAWNPSQDPQALLEDWTRLTFGSDPLVLGVVTEISMASWPAYENYTGNLGIQTLTDILYTHYGPNPASQDNNGWGMWTRADHDGIGMDRTVSTGTGFSGQYPAKVAEKFESIETTPDDLLLWFHHVNYTHVLKSGKSVIQHFYDAHYAGAETAQTFPIAWESLRNKIDTERFNDVLFRLRYQAGHSIVWRDSICQFYYNLSGIPDGTGRVGRHEYRIEAETMALKNYKLTGVNPVETASNLTAVVLVSNHTSGEATTKLNFDSGNYDVAINYFDLIGGKAHYKAFLNGKLLLEWAGDLEDKLGHTFSTKLDGHSATRVTIRDVQIQKGDVLKITGVADGNELAPLDYIAVLPQGVVD

SEQ ID NO: 30090 - protein, 332 aa, Neurospora tetrasperma; identical to SEQ ID NO: 30078
  strain FGSC 2509 / P0656

SEQ ID NO: 30091 - protein, 331 aa, Neurospora tetrasperma; identical to SEQ ID NO: 30048
  strain FGSC 2509 / P0656

SEQ ID NO: 30092 - protein, 292 aa, Neurospora tetrasperma
  strain FGSC 2509 / P0656
MVAFSSILLAASTVISGVFALPGELPGQGSLFKRQTYTSSATGTHNGYYFSFWTDGQGSVRYTNEAGGQYTATWSGNGNWVGGKGWMPGTDRTINYTGTYSPNGNSYLAVYGWTRNPLIEYYVVENFGTYNPSTGATRLGSVTSDGGVYDIYRTQRVNQPSIDGTATFYQYWSVRQQKRTGGSVNMKNHFDAWTRSGLTLGTHNYQIVATEGYFSSGSSTINVGASSDGGGGGGTTPENPGTTTTPTNPGNGGGGSCAAKWGQCGGQGWSGATCCQSGSTCQAANQWYSQCV

SEQ ID NO: 30093 - protein, 354 aa, Neurospora tetrasperma; identical to SEQ ID NO: 30050
  strain FGSC 2509 / P0656

SEQ ID NO: 30094 - protein, 484 aa, Neurospora tetrasperma; identical to SEQ ID NO: 30049
  strain FGSC 2509 / P0656

SEQ ID NO: 30095 - protein, 440 aa, Neurospora tetrasperma; identical to SEQ ID NO: 30051
  strain FGSC 2509 / P0656

SEQ ID NO: 30096 - protein, 315 aa, Neurospora tetrasperma; identical to SEQ ID NO: 30052
  strain FGSC 2509 / P0656

SEQ ID NO: 30097 - protein, 312 aa, Neurospora tetrasperma; identical to SEQ ID NO: 30053
  strain FGSC 2509 / P0656

SEQ ID NO: 30098 - protein, 659 aa, Neurospora tetrasperma; identical to SEQ ID NO: 30054
  strain FGSC 2509 / P0656

SEQ ID NO: 30099 - protein, 390 aa, Neurospora tetrasperma
  strain FGSC 2509 / P0656
MREFMNYITNAFYGATGWNEDNKYNELNATSRELIDFPLPRGLRLTLSSLATPHFATSYQLGSVGVVDGSISYLHSSIPLTHIAAQSDKIPLPALLRCYRRLHDLRSPGQQHYILDADPLSGLPPSPQSARALLGAASDAAVAGGALDGGSTDQDLGIYTHSLLYGRLYLPKSLLEGMIIKRFTQALQLQVRAVSEQSLRNGGTILGLVQYDKGKYGLEGLYSTDGGLLGFRGLYNFGGDASSSTCDPWTPTPGENNNNNNNNNNNNGNAQAGEKERIYGRFSVGGELYYGTLNKSGGMSLGARFATLPAHRGTPLTATLTINPLMGNINATKNDEYKGVLKARLDNNLRMGLLWEGRAKSLIFSIGTGIDLHKLGEPFRSLGLEVQYSS

SEQ ID NO: 30100 - protein, 586 aa, Neurospora tetrasperma; identical to SEQ ID NO: 30059
  strain FGSC 2509 / P0656

SEQ ID NO: 30101 - protein, 342 aa, Neurospora tetrasperma; identical to SEQ ID NO: 30057
  strain FGSC 2509 / P0656

SEQ ID NO: 30102 - protein, 829 aa, Neurospora tetrasperma; identical to SEQ ID NO: 30058
  strain FGSC 2509 / P0656

SEQ ID NO: 30103 - protein, 97 aa, Neurospora tetrasperma; identical to SEQ ID NO: 30056
  strain FGSC 2509 / P0656

SEQ ID NO: 30104 - protein, 702 aa, Neurospora tetrasperma
  strain FGSC 2509 / P0656
MAFSQFQPIGALTGVSFGISSSKVLRLADENGPEPPKDSTVLLPTMTTIGRILYKIDREIAVTDGMEGTVSSTTSTDCQLVKIMFDILIIGAGPSGLCAAKTFLQHNPTSNIVILDSHSTIGGVWSKERLYPTLRTNNLYPTMDFSDFPMKGVGIGRPGHHITGEEMHAYLTACAHHFDLMKRIRFNTRAVRVHQVQEAAPTSDDGWKVDVHELGNPTTTTTLKAKKLVMATGILGVPNMPSLKGSETFDAPLLHSSALGPRYQDVLQNPHINRVAVLGGSKSAYDTVYLAATTGHKVDWIIRKSGRGPSWVFPSHTKIGPFKAWREKLVTRRIFTFMSPCVLPDHSGKHISWIRDFLHTNKVGKAITKRFWKILHADTIRDCRYREEKEDKNFSVLEPDHSPFWYGTSSGTLNYEQDFKALVTSGQVTVHRQDISHLSPHTIHFFADNNETTSLTAIDALICATGYSPQPPIDFFPPELHFQLGIPTTTDSLSDEEKAIWATYDQEADEVITKRFPQLIPPPPSIPTLTPTSVLCSPKTQESKQYTPWRLHRGIAPPTLTTSHTRNSLVFLSMHSNITNIPRIELQCLWSLAYFNDKLKVSPLQQVLYKDTALFQRWCQLRSPLGHGRQYPDLNFDQLPYWDWLVADLGLKVRRKKSVWRELVSPYGSEDYRGLVGEWIEKYGIDKGEGSDQNRREGEKRL

SEQ ID NO: 30105 - protein, 355 aa, Neurospora tetrasperma; identical to SEQ ID NO: 30062
  strain FGSC 2509 / P0656

SEQ ID NO: 30106 - protein, 292 aa, Neurospora tetrasperma; identical to SEQ ID NO: 30061
  strain FGSC 2509 / P0656

SEQ ID NO: 30107 - protein, 364 aa, Neurospora tetrasperma; identical to SEQ ID NO: 30067
  strain FGSC 2509 / P0656

SEQ ID NO: 30108 - protein, 378 aa, Neurospora tetrasperma; identical to SEQ ID NO: 30066
  strain FGSC 2509 / P0656

SEQ ID NO: 30109 - protein, 421 aa, Neurospora tetrasperma; identical to SEQ ID NO: 30065
  strain FGSC 2509 / P0656

SEQ ID NO: 30110 - protein, 514 aa, Neurospora tetrasperma; identical to SEQ ID NO: 30064
  strain FGSC 2509 / P0656

SEQ ID NO: 30111 - protein, 252 aa, Neurospora tetrasperma; identical to SEQ ID NO: 30063
  strain FGSC 2509 / P0656

SEQ ID NO: 30112 - protein, 629 aa, Neurospora tetrasperma
  strain FGSC 2509 / P0656
MSTAVRICVCGDEGTGKSSLIASLVKGVFVANKIQAVLPQVTIPPTTGTPENVTTTIVDTSARPQDRTTLRKEIRKSNVILLVYSDHYSYERVALFWMPYFRSLGVNVPVVLCANKSDLVSDGNAAQVAEEEMLPVMAEFREIDSCIRTSAKEQKNVIEVFYLCQKAVTHPIAPLFDYKEGQLKPACVDALRRIFFLSDKDQDGCLNDQEMQDFQQKSFDKPLSQEDLDNIKLTVSKSVPSSSTDKGLDLRGFLQLNKLYAEKGRHETIWIILRKYHYTDSLSLEDSFLHPRFDVPDYASAELSPAGYRFFMDLFLTFDKDNDGGLNDRELAALFAPTPGLPHSWAETSFPSTTVRNEAGHITLQGWLAQWSMTTFLEPKTTLEYLAYLGFETPNARETTTAALKITKPRKRRRRPGRVDRNVVLCYILGSSGAGKSSLLDVFLNRPFDTLYHPTIKPRQAVNSVELQGGKQCYLILEELGELEPAILENQAKLDACDLICYAYDSSEPDSFSHIVELRKRYPQLDELPAVYTALKADRDKTTQRSELQPDAYTAALNMSAPLHVSVTWNSISELFVALAEAATNPSTAFPRSEEPPADRASLYMALGATACAALAAFMIWRRSTSNAA

SEQ ID NO: 30113 - protein, 302 aa, Neurospora tetrasperma
  strain FGSC 2509 / P0656
MRFHTITSLSTTFTTIFTILTFNHVLPVQAKPQQQPSKASIFHVRHIDNLNLNTHLPKPTPPAKFLLQHAKEPITITISTITITITATTTPSNTPASSSAPSFLNPALFTSALLNSTNFYRAQHNASAVIYNDTLSSFASHYLDKLGLPSSSSSSSSSSSKSKSKSSSTTTKCELTHSHGPYGENLALGCSDVQSCVEMWGDERAKYDFGSQAKFGEDTGHFTQLVWKDTTDVGCAARWCQGWNAGRGGWYLVSQRSIDIDNDTSWIPPTSSPAMSRCPLPAYSSSSESTILVSSNLQHVPI

SEQ ID NO: 30114 - protein, 427 aa, Neurospora tetrasperma; identical to SEQ ID NO: 30072
  strain FGSC 2509 / P0656

SEQ ID NO: 30115 - protein, 293 aa, Neurospora tetrasperma; identical to SEQ ID NO: 30071
  strain FGSC 2509 / P0656

SEQ ID NO: 30116 - protein, 299 aa, Neurospora tetrasperma; identical to SEQ ID NO: 30070
  strain FGSC 2509 / P0656

SEQ ID NO: 30117 - protein, 841 aa, Neurospora tetrasperma; identical to SEQ ID NO: 30069
  strain FGSC 2509 / P0656

SEQ ID NO: 30118 - protein, 424 aa, Neurospora tetrasperma
  strain FGSC 2509 / P0656
MVTMSTWPWGLLVTTGYLLNLTFAAHPLTTDANCHCYKTNATSTNYFRQHKFFDFRNLQQYANTPPNPISTFEGNAAAPPTSSYFDSNQWKDNWGIQTWNNTELMRLNNTDVNDATVPMINSFNNIYIERSSDRNANGQTYLVMRTVRHSLDGPSTRYGSNSSSGFQSSAEFESKLTSYQFLSLRMLARTRGSPGAVTAMFTYRPPPQPQQLALVQEADLEIRTQDPPNFVQYTNQPAWNSTSDIKEATRNASMPSGKKWSDWAFYRMDWTPGQSTWFVNGVEASKINFQAPRDPSQVMFNVWSDGGSWSGIMGQGGKAEMQVQWIEMVYNSTEVSGPVTGPWGDKKGCANICSIDETTQLGTPVLISNPNGEFSPRGNTPANPPNSCTTVKYGQCNGKNWNGCKTCASGSACRYQNDYYSQCL

SEQ ID NO: 30119 - protein, 501 aa, Paenibacillus alvei
  Bacillus alvei
MKKKSNHLKGRKVLVSLLVSLQVFAFASISSAAPTEPNDIDMGIAGLNYNRNEVLAIQGDQISSFVPKEGIQSNGKFIVVERDKKSLTTSPVDISIVDSITNRTYPGAIQLANKDFADNQPSLVMAARKPLDISIDLPGLKNENTISVQNPNYGTVSSAIDQLVSTWGEKYSSTHTLPARLQYAESMVYSQNQISSALNVNAKVLNGTLGIDFNAVANGEKKVMVAAYKQIFYTVSAGLPNNPSDLFDDSVTFAELARKGVSNEAPPLMVSNVAYGRTIYVKLETTSKSNDVQTAFKLLLNNPSIQASGQYKDIYENSSFTAVVLGGDAQTHNQVVTKDFNVIQSVIKDNAQFSSKNPAYPISYTSVFLKDNSIAAVHNNTEYIETKTTEYSKGKIKLDHSGAYVAQFEVYWDEFSYDADGQEIVTRKSWDGNWRDRSAHFSTEIPLPPNAKNIRIFARECTGLAWEWWRTVVDEYNVPLASDINVSIWGTTLYPKSSITH

SEQ ID NO: 30120 - protein, 714 aa, Paenibacillus macerans
  Bacillus macerans
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGGMYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 30121 - protein, 713 aa, Paenibacillus macerans
  Bacillus macerans
MKKQVKWLTSVSMSVGIALGAALPVWASPDTSVNNKLNFSTDTVYQIVTDRFVDGNSANNPTGAAFSSDHSNLKLYFGGDWQGITNKINDGYLTGMGITALWISQPVENITAVINYSGVNNTAYHGYWPRDFKKTNAAFGSFTDFSNLIAAAHSHNIKVVMDFAPNHTNPASSTDPSFAENGALYNNGTLLGKYSNDTAGLFHHNGGTDFSTTESGIYKNLYDLADINQNNNTIDSYLKESIQLWLNLGVDGIRFDAVKHMPQGWQKSYVSSIYSSANPVFTFGEWFLGPDEMTQDNINFANQSGMHLLDFAFAQEIREVFRDKSETMTDLNSVISSTGSSYNYINNMVTFIDNHDMDRFQQAGASTRPTEQALAVTLTSRGVPAIYYGTEQYMTGNGDPNNRGMMTGFDTNKTAYKVIKALAPLRKSNPALAYGSTTQRWVNSDVYVYERKFGSNVALVAVNRSSTTAYPISGALTALPNGTYTDVLGGLLNGNSITVNGGTVSNFTLAAGGTAVWQYTTTESSPIIGNVGPTMGKPGNTITIDGRGFGTTKNKVTFGTTAVTGANIVSWEDTEIKVKVPNVAAGNTAVTVTNAAGTTSAAFNNFNVLTADQVTVRFKVNNATTALGQNVYLTGNVAELGNWTAANAIGPMYNQVEASYPTWYFDVSVPANTALQFKFIKVNGSTVTWEGGNNHTFTSPSSGVATVTVDWQN

SEQ ID NO: 30122 - protein, 1196 aa, Paenibacillus polymyxa
  Bacillus polymyxa
MTLYRSLWKKGCMLLLSLVLSLTAFIGSPSNTASAAVADDFQASVMGPLAKINDWGSFKKQLQTLKNNGVYAITTDVWWGYVESAGDNQFDWSYYKTYANAVKEAGLKWVPIISTHKCGGNVGDDCNIPLPSWLSSKGSADEMQFKDESGYANSEALSPLWSGTGKQYDELYASFAENFAGYKSIIPKIYLSGGPSGELRYPSYYPAAGWSYPGRGKFQAYTETAKNAFRTAMNDKYGSLDKINAAWGTKLTSLSQINPPTDGDGFYTNGGYNSAYGKDFLSWYQSVLEKHLGVIGAAAHKNFDSVFGVRIGAKISGLHWQMNNPAMPHGTEQAGGYYDYNRLIQKFKDADLDLTFTCLEMSDSGTAPNYSLPSTLVDTVSSIANAKGVRLNGENALPTGGSGFQKIEEKITKFGYHGFTLLRINNLVNNDGSPTGELSGFKQYIISKAKPDNNGGTGNKVTIYYKKGFNSPYIHYRPAGGSWTAAPGVKMQDAEISGYAKITVDIGSASQLEAAFNDGNNNWDSNNTKNYSFSTGTSTYTPGNSGNAGTITSGAPAGANPGDGGGTTNKVTVYYKKGFNSPYIHYRPAGGSWTAAPGVKMQDAEISGYAKITVDIGSASQLEAAFNDGNNNWDSNNTKNYLFSTGTSTYTPGSNGAAGTIRTGAPSGSVLSVVTSTYATDLNEVTGPIQTEKLSGVSLNVSTSTYAPNSNGVEVTAQTEAPSGAFTSMDLGTLSNPTSLNTDWSKQSIYFIMTDRFSNGDPSNDNYGGFNSNNSDQRKWHGGDFQGIINKLDYIKNMGFTAIWITPVTMQKSEYAYHGYHTYDFYAVDGHLGTMDKLQELVRKAHDKNIAVMVDVVVNHTGDFQPGNGFAKAPFDKADWYHHNGDITDGDYNSNNQWKIENGDVAGLDDLNHENPATANELKNWIKWLLNETGIDGLRLDTVKHVPKGFLKDFDQAANTFTMGEIFHGDPAYVGDYTRYLDAALDFPMYYTIKDVFGHDQSMRKIKDRYSDDRYYRDAQTNGVFIDNHDVKRFLNDASGKPGANYDKWPQLKAALGFTLTSRGIPIIYQGTEQGYSGGDDPANRENMNFNANHDLYQYIAKLNYVRNNHPALQNGSQREKWVDDSFYSFQRSKNGDEAIVFINNSWNSQTRTIGNFDNLSNGTRLTNQLSNDSVQINNGSITVTLAPKEVKVFTK

SEQ ID NO: 30123 - protein, 590 aa, Paenibacillus polymyxa
  Bacillus polymyxa
MKKVWFSLLGGAMLLGSVASGASAESSVSGPAQLTPTFHTEQWKAPSSVSGDDIVWSYLNRQKKSLLGVDSSSVREQFRIVDRTSDKSGVSHYRLKQYVNGIPVYGAEQTIHVGKSGEVTSYLGAVINEDQQEEATQGTTPKISASEAVYTAYKEAAARIEALPTSDDTISKDAEEPSSVSKDTYAEAANNDKTLSVDKDELSLDKASVLKDSKIEAVEAEKSSIAKIANLQPEVDPKAELYYYPKGDDLLLVYVTEVNVLEPAPLRTRYIIDANDGSIVFQYDIINEATGKGVLGDSKSFTTTASGSSYQLKDTTRGNGIVTYTASNRQSIPGTLLTDADNVWNDPAGVDAHAYAAKTYDYYKSKFGRNSIDGRGLQLRSTVHYGSRYNNAFWNGSQMTYGDGDGDGSTFIAFSGDPDVVGHELTHGVTEYTSNLEYYGESGALNEAFSDVIGNDIQRKNWLVGDDIYTPNICGDALRSMSNPTLYDQPHHYSNLYKGSSDNGGVHTNSGIINKAYYLLAQGGTFHGVTVNGIGRDAAVQIYYSAFTNYLTSSSDFSNARAAVIQAAKDLYGANSAEATAAAKSFDAVG

SEQ ID NO: 30124 - protein, 30 aa, Paenibacillus polymyxa
  Bacillus polymyxa
ASIIKTTIKVSKAVCKTLTCICTGSCSNCK

SEQ ID NO: 30125 - protein, 39 aa, Paenibacillus polymyxa
  Bacillus polymyxa
ATYYGNGLYCNKQKHYTWVDWNKASREIGKITVNGWVQH

SEQ ID NO: 30126 - protein, 30 aa, Paenibacillus polymyxa
  Bacillus polymyxa
FVYGNGVTSILVQAQFLVNGQRRFFYTPDK

SEQ ID NO: 30127 - protein, 752 aa, Paenibacillus polymyxa
  strain SC2 Bacillus polymyxa
MSKRMDMPKGSGYDAWLHYHRARLIEKMPAWCRVIVVHDTDDEVLQTAASELQQGLASMFGQQPKMSTVPVHVPFVALGTFQDHPCIAERFSAEEQAEVSAEGYRIRGVEAKQLADSTGQDHDDIKGQCVTVAGQNSKGVLYGVFHLLRYLQGGLDGKLKPTAKESLHAPSLDLLSNPANPIRMINHWDNMDGSVERGYAGPSIFYNNNAFTTNMERLRDYARLLASVGIQALSINNVNVHQVETELITDRFLPDVAKVAAIFRAYGIQIYLSINYASPIQLGGLTTADPLDPGVAEWWQTKAREIYAAVPDLGGFVVKADSENRPGPFSYGRHHADGANMLADALRPYGGRVIWRCFVYDCKQDWRDRKTDRARAAFDHFKPLDGLFRDNVILQIKNGPMDFQVREPVSPLFGALEATQVLLEFQIAQEYTGQQKHLCYLVPQWKEVLDFDTYAQGKGSTIKRIVSGALHSNSESGSHHRKATVHAGSGSFQEEPTNHVPKGTNFGIAAVSNIGADTNWTGHLLAQSNLYGYGRLSWDPDLSADEIADEWVRLTFSNQGKDCGDPELIPTIKQMLLDSWNIYESYTAPLGVGWMVSPNHHYGPDVDGYEYSMWGTYHFADCWGIGVDRTTATGTGYAGQYFPPVAEIYESTDTCPDELLLFFHHVPYTHVLHSGQTVIQHIYDTHFEGAERAAHLQATWISLREHLNELIYEQVLTRLEHQTEHAKEWRDRINTYFYRKSGIPDEKNRPIY

SEQ ID NO: 30128 - protein, 265 aa, Paenibacillus polymyxa
  strain SC2 Bacillus polymyxa
MKNKTFFSLLCAFIISIMGLTACGVSSSKDHSLLSKEEFEQMYVNADQFEDRSINFYGQITYGPKENRNGIYVQVNADPKNNEKNTFVYGDSFSSFSNVKENDFIHVTGTVIEKYRYRTTHGNYTSAPAIAANKIEKSMFIDPTLSTIEVNKSVKQKGYIMTLQKVEFAEEETRIYMAIENRSTSTINYYDFYTKLVQGNKQYEPTFDRVSYTYPELQSEILPGVKTEGILTFSKIDSSKDLTLIAKGSSEELEYNPFKFKISKK

SEQ ID NO: 30129 - protein, 333 aa, Paenibacillus polymyxa
  strain SC2 Bacillus polymyxa
MFKISSKLISHKTKFFMILLSFSVIASFSSLYGPLPAKALAEENGTPVQETNESNIQQIPLTSEETTSQTAVTAIDHDANFSPSTLQFLKDNTGLDGEQWDNIMKLVNKPEQDSLKWTEFYGYAEDIGDDRGYTIGIFGATTGGSNDTGPDGPALFKAFDAASGASNPSIAGGLARAGLKGKMSGSILKLSDSDSVIKKKIKALQNNEAWREAMWRTFYDTYIEYSVQQARKRGFNTALTIGSFVDTALNQGATGDDGSLEGVLSRSGNSTNEKTFMTNFYAKRTLVVDTNDYNQPPNGKNRVKQWSSLLASGETDLKNADVAIIKVTNWEMK

SEQ ID NO: 30130 - protein, 230 aa, Paenibacillus polymyxa
  strain SC2 Bacillus polymyxa
MKTNTAKVLKKGMSIALSGMLIALFVGNYSAHAAPEVVHKTILVKAGEVYDGKGKTVVADPDTLGDGSQKEAQKPIFKLENNATLKNVIIAAPAADGVHVYGNGTISNVTWEDVGEDALTLKEPGTVNITGGGAYHAYDKVFQINAEGTINIKNFRADDIGKLVRQLGGSTFRVNMTLDNSDISNVKDSILRSDGPNSKAKITNTRYHNVKQLFKGFKSSNTSESGNTKY

SEQ ID NO: 30131 - protein, 428 aa, Paenibacillus polymyxa
  strain SC2 Bacillus polymyxa
MTIISDVYAREVLDSRGNPTVEVEVYLESGAIGRAIVPSGASTGAHEAVELRDNDKSRYLGKGVLQAVKNVNEIIAPEVIGLDAVNQVEIDTLMIKLDGTPNKGKLGANAILAVSMAVARAAAEALGLPLYTYLGGFNAKQLPVPMMNIVNGGAHADNNVDVQEFMVLPVGAPTFKEALRVGAEIFHNLKSVLNSKGLNTAVGDEGGFAPNFKSNEEALSTIIEAIEKAGYKPGVDVFLGMDVASTEFFKDGKYTLEGEGKSFTSAEFVDLLASWVDKYPIITIEDGCSEDDWEGWKLLTEKLGNKIQLVGDDLFVTNTERLAKGIDENIGNSILIKVNQIGTLTETFDAIELAKRAGYTAVISHRSGESEDSTIADIAVATNAGQIKTGAPSRTDRIAKYNQLLRIEDQLGELAQYHGLKSFYNLKK

SEQ ID NO: 30132 - protein, 496 aa, Paenibacillus polymyxa
  strain SC2 Bacillus polymyxa
MSMKHKRPFRFSGASKKDEDCKPPRDNRSIEALLKLIHELTSIVPLVFANPSAANVSLLQQILRQLLSLAKSLRLRSGAKADLLAALELAIVALEATPFSPISVGTTLQQLLDALLSIVLQESLNSTLKDSLIRAIRTAGTTVSNALSEPYLSGEPGPQGPPGPVGPGGAPGPAGVPGPPGPPGPVGPGGAPGPAGVPGPPGPPGPVGAAGPIGAEGPAGPVGAAGPIGAVGPAGPAGPAGGVTGATGATGADGLVGPAGATGPTGADGLPGAVGAVGPAGATGPTGADGLPGAVGAVGPAGATGATGVGGATGATGVTGATGSGAIIPFASGGPAILTTVLGGLVGTTSLIGFGSSATGIGLVNGVIDLTGTLVGPLINFAFSVPRGGVITSITGYFSTTAALTLLGSSVSITAQLFSSPTPNNTFIAVPGATVTLTPPLTDIVALGTTSSGIATGLAIPVTAQTRLLMVFSATATGVSLVNTVVGYASAGVTIT

SEQ ID NO: 30133 - protein, 208 aa, Paenibacillus polymyxa
  strain SC2 Bacillus polymyxa
MGRPELNRKKGRKKDVFVRAWFDKLEKKFEEMPPKKRGRSKRKSFGKDIIVKKQVVHVNINHDAEGDSRTTGDLAQFGYIYNVRPQLVSIEGEVIFDTNGILTPGIAHLPGTTQIAVADAGKYEVHFSVSGIEPNQFAIFINGVLAEGTVYGSGAGTQQNTGQAVLALACGDVLTLRNHSSTAAVTLQTQAGGTQASVNASVLIRKLG

SEQ ID NO: 30134 - protein, 146 aa, Paenibacillus popilliae
  Bacillus popilliae
MRQQIGMKWASIWLAAAIAAGSPAGFAAAKPKGALPVEGATELRAASALAIKEFPSSTGQAGAEGELSSEAAKSAGISDPQPRSLNSEARKHGPYSMAELNSLSYRELTDLLVSITWEEIPELFKYNDDTHRFYADEARFQAMVDR

SEQ ID NO: 30135 - protein, 430 aa, Solibacillus silvestris; identical to SEQ ID NO: 28545
  strain StLB046 Bacillus silvestris

SEQ ID NO: 30136 - protein, 242 aa, Staphylococcus arlettae CVD059
MKKTIIASTLAVGLGVTGVASGQADASEQNIDKAQLANTAQNNPQQLNDAPVHEGSYNYDFNHDKVDYNFDSDGTYWSWSYNGYGQGAADTSAQSTQGTEQSAPAEQATNNTEQTASTEQSEQAEEPQQTAAPQTEQTEQPQQESTSASSEDTSSSEASSGSSVEVNDHLKQIAQRESGGDINATNPSSGASGKYQFLQSTWDSVAPAEYQGQPAASAPESVQDAAAMELYETEGPSQWVTA

SEQ ID NO: 30137 - protein, 291 aa, Staphylococcus arlettae CVD059
MKRLNTWLSNHKMKNIPTLIVLVIFIVFVIMLIAFLNHNDEDSSTIYITEDADMLTGPNATYPKIKSVSKGQNFHKIGESGKWIEIESNNGKEKGWIAGWHTNLNIAPDKTASAKPLKNKTIVLDPGHGGSDQGASSNTQKKSLEKVYTLKTAQELKTLLEKEGAHVKMTRETDEYVTLDERNLKGDAFISIHNDSLKSQKANGSTVYWFKKNQKALAETLNASIQKKALLSDRGARQQNYQVLRQTNVPAVLLELGYISNPTDENMIRDELHRKIVEQAVIDGLRSYFAE

SEQ ID NO: 30138 - protein, 743 aa, Staphylococcus arlettae CVD059
MDTRKPKYSIRKLSIGAASALVGVLLFVSHDSAHAAEQQNSATTETTEVKDKGTTAQDSEKPDASVKQQGTEAVAQNSEEKSVTSTEDHKQSTTQKSDTGQFERPKTSEDAQVTITQAEVDNNSPKSTNKKNNSEQYIESATVDKSNAATTTDTTQHNQFEQTASKKQSSDKQVQSKASVSTAEHSVTTDDTTSSTTSPSPVKADQQREPVAHHQSSEILSDHQLTDKQTKATQHNWTKVQPKLDRQQRSTLPEQQRNNTIKPTKATINEVTDQSYTDATTQQQKYTDHQSVATTNNTTTSLAEIGAPLLVHGSSRNSTPEEQKSLAALEGNTQATRTNNTTQEATPITDDQPTKVAKQGQFKNEDPIILVHGFNGFTGDNKPTTEGNYWGGDKLSISQDLRDSGYETYEASVGALSSNYDRAVELYYYIKGGTVDYGAAHAAKYGHARYGRTYEGVYKDWQPGQQVHLVGHSMGGQTSRLLDTMLREGNQEEIAYQAQHGGEISPLFQGGNDDMITSVTTVGTPHNGTHAADQLGNEQLIRQIAYDYSKFQNNKWSQVDYGFSQWGLKQRPNETYIDYVKRVKAESNIWLTDDNGFYDLTRQGAAQLNEQTSLDPNAVYKTYTGESTRASITGRQVSDINMNPSFRLTGNVIGKAAETEWRENDGLVSVVSAQHPFNQDFVTATDDVQKGVWQVTPVKHDWDHEDFIGSDVTQSVVTTEELQQFWHGIAADLVRNENIAAQA

SEQ ID NO: 30139 - protein, 222 aa, Staphylococcus arlettae CVD059
MKKTVIASTLAVGLGVTGLASGQADASEQDINKEKLAQLAQSGSAQLDAAPIAEGAYNHNFTVDGVNYSFKSDGQNFSWSYGEGSGEKSSDASSQSSSEQSAPAVAAEQPQQESAPQQTEATTTTSTSTTTTTTSTEASSGSSVNVNSHLQQIAQRESGGDITAINPSSGAAGKYQFLQSTWDSVAPSEYVGQSPASAPESVQDAAAVKLYNTAGASQWVTA

SEQ ID NO: 30140 - protein, 434 aa, Staphylococcus arlettae CVD059
MPIITDVYAREVLDSRGNPTVEVEVLTESGAFGRALVPSGASTGEHEAVELRDGDKSRYLGKGVTKAVENVNEIIAPEIVEGEFSALDQVSIDKMMIQLDGTENKGKLGANAILGVSIAVARAAADLLGQPLYKYLGGFNGTELPVPMMNIVNGGSHSDAPIAFQEFMILPVGAATFKESLRWGAEIFHNLKSILKNRGLETAVGDEGGFAPKFEGTEDAVETILEAIKAVGLEPGKDVFLGFDCASSEFFEDGVYNYAKFEGENGSKLTAEQQVDYLEELVNKYPIITIEDGMDENDWDGWKVLTDRIGDRVQLVGDDLFVTNTVKLEEGIEKGIGNSILIKVNQIGTLTETFEAIEMAQKAGYTAVVSHRSGETEDTTISDIAVATNAGQIKTGSLSRTDRIAKYNQLLRIEDELFETAKFKGLKAFYNLSK

SEQ ID NO: 30141 - protein, 2354 aa, Staphylococcus arlettae CVD059
MNNNKKVQKYSIRKYSVGAASILIGTLLFLNPSTAEAQELEPKSNETTTKENEELSQGNDVTNTDEVQEQELPAEVNTSQKTDEPSDVEEISSQEEKAQKLDEAEAQEVTSEENKVQSTDESKNKKEVTRQKSNEQNADEAPEQEVNTQVNQFRNLDEATDEEKAPLEEKEVQKSDNEQTQKVNELQNIDELKGKKEVSSQNKATQKTGGKNEQEFTPEVKQQLNNDNSIEEVTQEVKEAQKISEAPNQKVKLNIKSTPLKRNKRQLPELPPSNTDIPVVPLQNRAASHTFSPRSVSSSYQARYFSSMRGFNDITTNSTRRDAIEIIEKHKQHLTEKEREFYLRNIARKLNLPKNEKTWNNLFRNSIDNKLIGRKVAKNQVNDVNKVLESMKNLINNRQGNFYTEISNNNVKKITANDLRYVSTEKRGGKYVVSFDLTKELGSGVKRFETLSLKVNDSLNSKIEKVLVDYIPHKGLAEATKTLNRDKLGYYSFTTEPKNKAGASATFKLVLKSATEIDSAKDQIGVQLISDTNYPNPVHGVNLELKTVNMKPIAQKVNSDIKKIKEQEAKGQVQPPVDNQAKDEATKAVVEAEQAEQAAKDKLTKANEDGVINPNEHKELEEASNQADTKKKAAEAKVNALSENQKGDLPQRLDKLTGIDIPGINDKDSNGVADNIDKAKDEATKAIEEAEQADKVAKEAFTKANEDGVINPKEHQELEAASKKAKETKVAAEDKVKALPENQKVNLPQRLDKLTGIDVPNINDKDSNGVADDLDQAKDEATKAVEEAERADKEAKEKLANANKDGVINPNEHQELVAASKQAKETKAAAEAKVNALSESQKGDLPQRLSKLTGIDIPGINDKDSNGVADDLDQAKDEATKAVVEAERADKVAKDKLTKANEDGVINPNEHQELEEASKKAKETKAAAEAKVKALPENQKGELPQRLEVLTGIDVPNINDQDSNGVVNDLDQANDEAMKAVEEAEKADKVAKEKLAKAVEDGAINPKEHQELTEEANQAETKKKAASEKVNKLPKDKQDNLQERLDKLTGIKVPNVNDQDSNGLADELDGTLADVAKAVEAAKQADKSAIEALAKAKEDGKISQEEVNKLIELANQAKETKANAEVLVEELPETPKQLREKKAEFNEVLAQLTGITVPTVTDNVIPGQQDNMDQARADATKAVEEAERADKMAKEKLTKAVEDGVINPKEHQELVDLTQQAETKKKEAVAKVNALPESQKADLPQRLGKLIGIDIPNINDQDNNNLPDELDGTLADVAMAVEKAKQVAKAAKEALAKAKEDGKISQEEVNKLMDLAKLARETKATAKVLVEELPETPKQLKAKKAEFNEELAQLTGIVVPTVTSNVVPGQQDNMNQATVEASQAVEEAERADKMAKEKLANANKDGVINPKEHQELEEASKKAKETKATAEAKVNALPEKQKEEMPQRLEALTGINVPGINDKDSNGVADDLDQAKAEAMQAVEEAERADNMAKEKLAKAVEDGAINPKEHQELEEASKKAKETKATAETKVNALPESQKGDLPESLDKLTGIDIPNINDQESNGLADELDGTLIDVTKAVEAAKQVDKAAKEALAKAKEDGKISQEEVNKLTDLAKQAKETKVTAEVLVKELPETPKQLKEKKAEFNEVLGQLTGIVVPTVTSNVVPGQQDNMNQAKAEAMKVVEEAERADKVAKDKLTKAKADGAINPKEYQELEEASKKAKEIKATAETKVNALPESQKGDLPQRLDKLTGIDIPNINDQDSNGLADELDDTLADVAKAVEAAKQADAKAKEALVKANTDGKISQEEVNKLTDLAKLARETKATAEVLVEELPETPKQLKEKKAAFNEELAQLTGIVVPTVTSNVIPGQQDNMNQATAEASQAVEEAERADKMAKEKLANANKDGVINPKEHQELEEASKKAKETKATAEAKVNALPEKQKEKMPQRLEALTGINVPGINDKDSNGVADDLDQAKAEAMQAVEEAEQADKAAKEALAKANEDGKISQEEVNKLMDLAQQAKATKATAEAKVNALSESQKGDLPQRLEALTGINVPVINDKNSNGVANDLDQATADATQAVEEAEQADKVAKAALAKANEDGVINPKEHQDLIDLAQQAEATKKVASEKVNVLPQDKQVNLQERLDKLTGIKVPNVNSDVLPTAPSEDDKEMKPEVSGEDGNETTPTASSKAGKVMTPEESSKGDKITVSNASNENSKVMKPEVSGEDSKETIPTILSEDGNEVTSEESGKTNKLTTPTASIEDVNKVTLEESSKDDKETSSTVTSEVIAPKALSKDGKAMSSENLKNNSNNTINELPKTGNDGINSYIYTGVLALFGSLLLFVRRRKNKSN

SEQ ID NO: 30142 - protein, 1165 aa, Staphylococcus arlettae CVD059
MKTYKEHTARKHNKYAIRKFSVGLASIMVGSIIFFGHYMTAQASEVQNNEDSNQSSLQANNVTEVDVVSETGELKPNVQRSSNSTTVGTQDNLAEPNNAIHNITEGTNSVTENRNQQQQSVQETPNKADNTTKQGEAQNQVSNQLSQVRKANFQEIPRNIPQQNNNVQHSAPQVVANHSTPEYQSLDAKKVKRQVINKSTYDVDVLKIIEKNKQHLNEEERKFFLRMASRNTSFLPNDWSLIYNRNYKDISRNVFERKIGKVGKEKNEKVLTAMYDLIEQRNNNEFHTELSKDHKRYIKKHKYNLKQNINAQNPTIDIRLSKDIIAISQPNSVARFESWGLRLNENLANKIEEVKVNYNWNNKSIEKVINKDSNGFYWVRGDVDLPVKYHRAGGGMDFALKLRQGQFIDKINDKLWGYIIADSNQKATIVGSTLSFKKFDFAERNYDINFNEKLLTLQKNRLIRKINDNTENFINKDSLKQKYLQQVNHAIGNITTVKEFAQVHHTLEQINTSVERAAKELKTSTINSLDVNAQTKFVDVFKYIDAHKDKLTSEEHQFLLRMVSRFGTFLERDWNLMYQARYNEISNNVNTRVLGNQVNQINKILTNMRELIQSRNGENYFKDFSSDSQNKYRVNNYSVDSNITKDDMNRQQIVLGINKGQVTSLVSLYKKRINRFENWGLRTNEALNAKLASVKVRYRWANQDYERELVRSKEGVYWFDERQYHDDNKYHSGGGVKFVVTFKKGHILDHENDMAWGYVISDSKNKITDVGANIGFGKYDFRSNQLDATFNNNAVQIVKEDLQNYITKHQGTLLDKGGDVNHFTESLNAINTNGSNTEVIAQLSQLGRAINTAINKSVNQSNVIVIPTNKQHIGTYAKGLKDVYFISAQSLNTNPINSLNPDGSLDIQPKGYFFYKVKATDKLATGNKFNLQIKTKSVAEQTRFEYAFIGADNKYISKNLMIPKVEDGLYQLNNILVPKGTNAIMLRLDNRNGNSDVAIQNISLIAHEALTNEASRNNLIVVPPSQQHIANFAKSIKDSYFSSYQAKNSSPNNSFDKDGSLTIAPSGYFFYNLNTINDLAPGKQFKIQVITAHNADKSKVEYRFTKGENNEKLPIISVQKDAQGNFVSDNITVPENAKTLALRIDNRQGSEEFKILGVNVFPVQV

SEQ ID NO: 30143 - protein, 233 aa, Staphylococcus arlettae CVD059
MKKTVITSTLALGLGVTGVASGQADASEQGIDKAQLAHTAQNNPQQLNDAPIHEGAYNYDFNHDKVDYNFDSDGTYWSWSYNGYGQGTADTNAQSTQDTEQSAPAEQATSTEQSEQAEQPQQTAAPQTEETQQPQQESTSSNSESSSEATSGSSVNVNSHLQTIAQRESGGDITAINPSSGAAGKYQFLQATWDSVAPAEYVGVSPAEAPESVQDAAAVELYNTVGPSQWVTA

SEQ ID NO: 30144 - protein, 331 aa, Staphylococcus arlettae CVD059
MKKILCFMIVVVFVLAGCGTSGQESEKEEKSNEKSSSKAQATSKMKTFKIGQIVDADGVDVKVTKIEYVNDFDEYSAPENGKALKVHLKFKNNNEDQVLMDSTDFTMKVDNENYEQWFGTDDIHDGFSHQLNKGNTGSGYITYDVPDSEQYTLEMEASPKFDNVKAKWQIKKSDIKNEENSDSNQTNVSNEQSTNDDSVNEDVEESEEEASVEEESSDEITFTAEEYNDLVDEYNSLTDGEKMDHVNRDVIEIEYTQLEDRISALYDEQAEEDEKEYEEEMKQLEEEEKAEEERMEAEDKAFEEEMKREEAEYEAEMEKIDKELEEDLSEE

SEQ ID NO: 30145 - protein, 900 aa, Staphylococcus arlettae CVD059
MNNITYHNEHRSNYYAIRKYSVGTASILLGTFLIFGQHQQAQAAEHNKQAQTLEQYVDQSQVSLHKWDTDVQRDAQSIDKKIMNNDVVNTNKHLSVAHEHHNTPTYNDNKPEVSRPDNTLDNPANNVISTPSNTTQTTFPKQPVKSVEQSQASADKWLAPKKMYRESPQQENYTTAQMASTARDVVHSPATTINENIDTAVKGQEQVTKANFADHFRVIGNTSWYNPNTGIISLTDDTNNLVSAAYLTSKLDISQGFHLTGKVNLGHRSMAQNSGNGVSFILSPNSPGEIGKAGPAVGIGGLKNAFGFKLDTKFDGQESTFAKADPSYLNQLGAFGAFIHTTQDYQHKAITYNSKNGIEGPKLLRGKPDNNLFYPFSFEFNPKTEMLKVLYEGQTWERNIADWLRLSKTTKFNLTIFASTGPNGSNKQQFKFGSFTYVPTSTVYVQYKDVDTGENIARPNYLAGKAGDIISINHLQKDVSDDNYEFVMAEGPVKNNIITYTRENQNVILKYKMKKAVQPIDMNVNIEPQQPKVDTITTKSREITGTTDKNTEVKVVFSDGYTVHVQEDGTGRFTVIVPFGKRLTAGDTIQFLAKNKAGKISNTAQVTVIDPTVAKPQVKPSTQAPPQQSPEMKPNSLTSQQMDTKVMPKPSQPMPQMMDGGNQQSNQSNMKDDPVPMKPMNPGDMMEPSQPMPQVMDEGNKQSNVKEKQTAPVPMKPMSPGDMMEPSQPMPQAMDEGNEQSNVKEKQTDPVPMKPMNPGDMMKPSQPMPQAMGGGNKQSKQSNMKAGQQSMSPQYKEVMTKQSQSTTQSNSATTTKWMADMPEKDTVMWKMDKPSSTTSEPAQHKPTMKKKMWNENSVQHTLPKTGINEGTTVTIFASFLAILGSVLLLVGRKGLVQREK

SEQ ID NO: 30146 - protein, 315 aa, Staphylococcus aureus
MIFMVKKRLLAATLSLGIITPIATSFHESKADNNIENIGDGAEVVKRTEDTSSDKWGVTQNIQVDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30147 - protein, 239 aa, Staphylococcus aureus
ESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30148 - protein, 254 aa, Staphylococcus aureus
IFALILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30149 - protein, 264 aa, Staphylococcus aureus
KRLFISHVILIFVLILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30150 - protein, 266 aa, Staphylococcus aureus
MYKRLFISHVILIFVLILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30151 - protein, 234 aa, Staphylococcus aureus
MNKKLLMIFFIVSPLLLATIATDFTPVPLLSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30152 - protein, 239 aa, Staphylococcus aureus
MKRILIIVVLLFCYSQNHIATADVGVLNLRNYYGSYPIEDHQSINPENNHLSHQLVFSMDNSSITAEFKNVDDVKKFKNHAVDVYGLSYSGYCLKNKYIYGGVTLAGDYLEKSRCIPINLWVNGEHQTISTDKVSTNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 30153 - protein, 256 aa, Staphylococcus aureus
MKLFAFIFICVKSCSLLFMLNGNPKPEQLNKASEFTGLMDNMRYLYDDKHVSETNIKSQEKFLQHDLLFKINGSKILKTEFNNKSLSDKYKNKNVDLFGTNYYNQCYFSSDNMELNDGRLIEKTCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 30154 - protein, 250 aa, Staphylococcus aureus
MKELIVIVLFLSVSQIKDNTFQTSSEDLHHKSELSSLALNNMRHNYFHRWPPVKGENKITNDQFLANTLLFKDFLTNHQYYNDLLVQFNSKETTDKFKAKTVDIYGLAYGFQCNGGEPNKTNCIYGGLTTHEDNKLDKPKNVPINLWIDGAQKRVSLDKVKTDKKTVTIQELDAQARYFLQGEYLLYHNDSFGGKIQKGFIEFHDANGFEVSYDLFDVKGDYPDTQLRIYNDNKTISSKNLHIDIYLFTK

SEQ ID NO: 30155 - protein, 247 aa, Staphylococcus aureus
MKNKLLFKIFLSLSLALSVYSINDKIIEVSNTSLAADVKNFTDLDEATKWGNKLIKQAKYSSDDKIALYEYTKDSSKINGPLRLAGGDINKLDSTTQDKVRRLDSSISKSTTPESVYVYRLLNLDYLTSIVGFTNEDLYKLQQTNNGQYDENLVRKLNNVMNSRIYREDGYSSTQLVSGAAVGGRPIELRLELPKGTKAAYLNSKDLTAYYGQQEVLLPRGTEYAVGSVELSNDKKKIIITAIVFKK

SEQ ID NO: 30156 - protein, 996 aa, Staphylococcus aureus
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 30157 - protein, 809 aa, Staphylococcus aureus
MNKNVLKFMVFIMLLNIITPLFNKNDAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSLNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKLKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVETVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKVDQPKDNKAKPENPLKELPKTGMKIITSWITWVFIGILGLYLILRKRFNS

SEQ ID NO: 30158 - protein, 1183 aa, Staphylococcus aureus
MNKNVLKFMVFIMLLNIITPLFNKNDAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSLNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKLKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVETVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWSHTWTGLDEKAKGQQVKYTVEELTKVKGYTTHVDNNDMGNLIVTNKYTPETTSINGEKVWDDKDNQDGKRPEKVSVNLLANGEKVETVDVTSETNWKYEFKDLPKYDEGKKIEYTVTEDHVKDYTTDINGTTITNKYTPGETSATVTKNWDDNNNQDGKRQTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVETVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKVDQPKDNKAKPENPLKELPKTGMKIITSWITWVFIGILGLYLILRKRFNS

SEQ ID NO: 30159 - protein, 257 aa, Staphylococcus aureus
MKKTAFILLLFIALTWTTSPLVNGSEKSEEINEKDLRKKSELQGTALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 30160 - protein, 241 aa, Staphylococcus aureus
TTSPLVNCSEKSEEINGKDLQKKSELQGTALSNLRQTYYHNGSAIIENKEGNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 30161 - protein, 241 aa, Staphylococcus aureus
TTSPLVNCSEKSEEINGKDLQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIGFHPSSGDSVGYDLFGAQGQYPDTQLRIYRDNKTIKSKNMHIDIYLYTT

SEQ ID NO: 30162 - protein, 251 aa, Staphylococcus aureus
MRLFYIAVIIITLLCLINNKYVNAEVDKKVLKKKSDIDSSNLFNLTSYYTDITWQLDESNKISTDQLLNNTIILKNIDISVLKTSSLKVEFNSADLANQFKGKNIDIYGLYYGNKCVGLTEEKTSCLNGGVTIHDGNQLDEEKVIGVNVFKDGVQQEGFVIKTKKAKVTVQELDTKVRFKLENLYKIYNKDTGNIQKGCIFFHSHNHQDQSFYYDLYNIKGSVGAEFFQFYSDNRTVSSSNYHIDVFLYKD

SEQ ID NO: 30163 - protein, 251 aa, Staphylococcus aureus
MRLFYIAVIIITLLCLINNKYVNAEVDKKVLKKKSDIDSSNLFNLTSYYTDITWQLDESNKISTDQLLNNTIILKNIDISVLKTSSLKVEFNSADLANQFKGKNIDIYGLYYGNKCVGLTEERTSCLNGGVTIHDGNQLDEEKVIGVNVFKDGVQQEGFVIKTKKAKVTVQELDTKVRFKLENLYKIYNKDTGNIQKGCIFFHSHNHQDQSFYYDLYNIKGSVGAEFFQFYSDNRTVSSSNYHIDVFLYKD

SEQ ID NO: 30164 - protein, 148 aa, Staphylococcus aureus
TISYTQKSYVSEVDKQNSKSVKWGVKANEFVTPDGKKSAHDRYLFVQSPNGPSGSAREYFASDNQLPSLVQSGFNPSFITTLSHEKGSSDTSEFEISYGRNLDITYATLFPRTGIYAERKHNAFVNRNFVVRYEVNWKTHEIKVKGHN

SEQ ID NO: 30165 - protein, 157 aa, Staphylococcus aureus
  MOD_RES (101)..(101): Any amino acid
GNGSFNYSKTISYTQKSYVSEVDKQNSKSVKWGVKANEFVTPDGKKSAHDRYLFVQSPNGPSGSAREYFASDNQLPPLVQSGFNPSFITTLSHEKGSSDTXEFEISYGRNLDITYATLFPRTGIYAERKHNAFVNRNFVVRYEVNWKTHEIKVKGHN

SEQ ID NO: 30166 - protein, 143 aa, Staphylococcus aureus
QKSYVSEVDKQNSKSVKWGVKANEFVTPDGKKSAHDRYLFVQSPNGPSGSAREYFASDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30167 - protein, 142 aa, Staphylococcus aureus
KSYVSEVDKQNSKSVKWGVKANEFVTPDGKKSAHDRYLFVQSPNGPSGSAREYFASDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30168 - protein, 235 aa, Staphylococcus aureus
MNKNVMVKGLTALDILTSLGCAENISDQPHSIAKAEKNVKEITDATKAPYNSVVAFAGGTGVVVGKNTIVTNKHIAKSNNIFKNRVSAHHSSKGKGGGNYDVKDIVEYPGKEDLAIVHVHETSTEGLNFNKNVSYTKFADGAKAKDRISIIGYPKGAQTKYKMFESTGTINHINGTIMEFDAYAQPGNSGSPVLNSKNELIGILYAGSGKDESEKNFGVYFTPQLKEFIQNNIEK

SEQ ID NO: 30169 - protein, 234 aa, Staphylococcus aureus
  MOD_RES (3)..(3): Any amino acid
  MOD_RES (62)..(62): Any amino acid
MNXKLLMKFFIVSPLLLATIATGFTPVPLSSNQIIKTAKASTNDNIKDLLDWYSSGSDAFTXSEVLDNSLGSMRIKNTDGSISLIIFPSPYYSPTFSKGEKVDLNTKRTKKSQHTSEGTWIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30170 - protein, 234 aa, Staphylococcus aureus
  MOD_RES (2)..(2): Any amino acid
  MOD_RES (8)..(8): Any amino acid
  MOD_RES (49)..(49): Any amino acid
MXKKLLMXFFIVSPLLLATIATGFTPVPLSSNQIIKTAKASTNDNIKDXLDWYSSGSDAFTNSEVLDNSLGSMRIKNTDGSISLIIFPSPYYSPTFSKGEKVDLNTKRTKKSQHTSEGTWIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30171 - protein, 239 aa, Staphylococcus aureus
MKRILIIVVLLFCYSQNHIATADVGVLNLRNYYGSYPIEDHQNINPDNNRLSHQLVFSKDNSTVTAEFKNVEDVKKFKNRAVDVYGLSYSGYCLKNKYMYGGVTLAGDYLEKSRCIPINLWVNGNLKTISTDKVSTNKKIVTAQEIDTKLRRYLQEEYNIYGFNDTNKGRNYGTKSKFFSGFNTGKISFHLNDGTSFSYDLFDTGTGQAESFLKIYNDNKTVETDKFHLDVEISYKDES

SEQ ID NO: 30172 - protein, 146 aa, Staphylococcus aureus
DIVDKYKGKKVDLYGAYYGYQCAGGTPNKTACMYGGVTLHDNNRLTEEKKVPINLWLDGKQNTVPLETVKTNNKNVTVQELDLQARRYLQEKYNLYNSDVFDGKVQRGLIVFHTSTEPSVNYDLFGAQGQYSNTLLRIYRDNKTIN

SEQ ID NO: 30173 - protein, 146 aa, Staphylococcus aureus
  MOD_RES (46)..(46): Any amino acid
  MOD_RES (70)..(70): Any amino acid
DIVDKYKGKKVDLYGAYYGYQCAGGTPNKTACMYGGVTLHDNNRLXEEKKVPINLWLDGKQNTVPLVTVXTNNINVTFQELDLQARRYLQEKYNLYNSDVFDGKVQRGLIVFHTSTEPSVNYDLFGAQGQYSNTLLRIYRDNKTIN

SEQ ID NO: 30174 - protein, 146 aa, Staphylococcus aureus
DIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQYSNTLLRIYRDNKTIN

SEQ ID NO: 30175 - protein, 146 aa, Staphylococcus aureus
DIVDKYKGKKVDLYGAYYGYQCAGGTPNKTACMYGGVTLHDNNRLTEEKKVPINLWLDGKQNTVPLETVKTNKKNVTVQGLDLQARRYLQEKYNLYNSDVFDGKVQRGLIVFHTSTEPSVNYDLFGAQGQYSNTLLRIYRDNKTIN

SEQ ID NO: 30176 - protein, 146 aa, Staphylococcus aureus
DIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGTQGPYSNTLLRIYRDNKTIN

SEQ ID NO: 30177 - protein, 146 aa, Staphylococcus aureus
DIVDKYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTLLRIYRDNKTIN

SEQ ID NO: 30178 - protein, 146 aa, Staphylococcus aureus
DIVDKYKGKKVDLYGVYYGYQRTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTLLRIYRDNKTIN

SEQ ID NO: 30179 - protein, 146 aa, Staphylococcus aureus
DIVDKYKGKKVDLYGVYYGCQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTLLRIYRDNKTIN

SEQ ID NO: 30180 - protein, 185 aa, Staphylococcus aureus
ESQPDPTPDELHKSSEFTGTMGNMKYLYDDHYVSATKVMSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKICMSLTVHHMKQDI

SEQ ID NO: 30181 - protein, 93 aa, Staphylococcus aureus
DKYRSITVRVFEDGKNLLSFDVQTNKKKVTAQELDYLTRHYLVKNKKLYEFNNSPYETGYIKFIESENSFWYDMMPAPGDKFDQSKYLMMYND

SEQ ID NO: 30182 - protein, 330 aa, Staphylococcus aureus
MVKKTKSNSLKKVATLALANLLLVGALTDNSSKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30183 - protein, 315 aa, Staphylococcus aureus
MLKNKILATTLSVSLLAPLANPLLEKAKAANDTEDIGKGNDVEIIKRTEDKTSNKWGVTQNIQFDFVKDKKYNKDALILKMQGFISSRTTYYNYKNTNHIKSMRWPFQYNIGLKTNDPNVSLINYLPKNKIESTNVSQTLGYNIGGNFQSAPSLGGNGSFNYSKSISYTQQNYVSEVEQQNSKSVLWGVKANSFVTASGQKSAFDSDLFVGYKPHSKDPRDYFVPDSELPPLVQSGFNPSFIATVSHEKGSGDTSEFEITYGRNMDVTHAIKRSTHYGNSYLDGHRIHNAFKNRNYTVKYEVNWKTHEIKVKGQN

SEQ ID NO: 30184 - protein, 196 aa, Staphylococcus aureus
STLEVRSQATQDLSEYYNRPYFDLRNLSGYREGNTVTFINHYQQTDVKLEGKDKDKIKDGNNENLDVFVVREGSGRQADNNSIGGITKTNRTQHIDTVQNVNLLVSKSTGQHTTSVTSTNYSIYKEEISLKELDFKLRKHLIDKHDLYKTEPKDSKIRVTMKNGDFYTFELNKKLQTHRMGDVIDGRNIEKIEVNL

SEQ ID NO: 30185 - protein, 197 aa, Staphylococcus aureus
STLEVRSQATQDLKDYYKGQSFDLKNIGGYKEGNKVTFIYHNQQIDVTLTGKEKLEFNDDEEISNIDVFVVRENSDRSGITNSNGGITYSNKQDDIDNVKSVNMQITKKTSSNTETVTSSYYSIDKENISLKELDFKLRKHLIDNNGLYNTEPKDSKIKVTMKDGGFYTFELNKKLQTHRMGDVIDGRNIEKIEVNL

SEQ ID NO: 30186 - protein, 216 aa, Staphylococcus aureus
MKKCILFIFSIILLVSISTLFIPNAKSDSREGLKDFYSKKIDVYTNKKINEKDKYSVDIEVDNYVYRINTLDDKILNQFKVGDYVDAWGHIINNKPIGKVIKFYDGDISKHSPLDKPTNISYRINLFKEQKQTEVTPEKELEIGNRYLTMKQIDYRIKSYLVKKQQLYTEFYNGKIEISMLDGKKHFIDLSTYYYDPSNFTLDYTKISHFDIYMEK

SEQ ID NO: 30187 - protein, 257 aa, Staphylococcus aureus
MNYSKITVTLIIILLCTFSFEFSFNRFVQADESRPKIESLKKKSELDSTALYNIKTSYSQDNIILDIKNKTNSTQLLSNDLIFDDITLKEWNKNSLKTEFNSSEIANHFKGKKVDIFGIYYGANCIGEVSKRTGCIYGGITLHEEEKIDQKNSIGVNVFKDGSQQKGFMITTDKKEPTIQELDLKTRKVIQNQYKIYNSETGNIQKGYMEFHSNSSSFYYDLFNFKGKYSVDFLKFYNDNKTINSSNLHIDVYLYSQ

SEQ ID NO: 30188 - protein, 271 aa, Staphylococcus aureus
VKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30189 - protein, 271 aa, Staphylococcus aureus
VKRTEDTSSDKWGITQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30190 - protein, 271 aa, Staphylococcus aureus
VKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30191 - protein, 271 aa, Staphylococcus aureus
VKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSYNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30192 - protein, 271 aa, Staphylococcus aureus
VKRTEDTSSDKWGVTQNIQFDFVKDKKYNKDALILKMQGFINSKTTYYNYKNTDYIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30193 - protein, 271 aa, Staphylococcus aureus
VKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRKMDVTHATRRTTHYGNSYLEGSRIHNAFVNRNYTVKYEVNWKTHEIKVKGHN

SEQ ID NO: 30194 - protein, 263 aa, Staphylococcus aureus
SDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30195 - protein, 260 aa, Staphylococcus aureus
WGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30196 - protein, 312 aa, Staphylococcus aureus
MVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30197 - protein, 323 aa, Staphylococcus aureus
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKNP

SEQ ID NO: 30198 - protein, 312 aa, Staphylococcus aureus
MVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSYNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30199 - protein, 90 aa, Staphylococcus aureus
CMYGGVTLHDNNRLTEEKKVPINLWLDGKQNTVPLETVKTNKKNVTVQELDLQARRYLQEKYNLYNSDVFDGKVQRGLIVFHTSTEPSVN

SEQ ID NO: 30200 - protein, 500 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30201 - protein, 48 aa, Staphylococcus aureus
NLTDNSHNILIKVYENERNTLSFDISTNKKNITAQEIDYKVRNYLLKH

SEQ ID NO: 30202 - protein, 42 aa, Staphylococcus aureus
HNILIKVFENERNSLSFDIPTNKKNITAQEIDYKVRNYLLKH

SEQ ID NO: 30203 - protein, 46 aa, Staphylococcus aureus
TDNSHNILIKVYENERNTLSFDISTNKKNITAQEIDYKVRNYLLKH

SEQ ID NO: 30204 - protein, 42 aa, Staphylococcus aureus
DNSHNILIKVFENERNSLSFDIPTNKKNITAQEIDYKVRNYL

SEQ ID NO: 30205 - protein, 226 aa, Staphylococcus aureus
MKLFAFIFICVKSCSLLFMLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVFENERNSLSFDIPTNKKNITAQEIDYKVRNYLLKHKNLYEFNSSPYETGYIKFIEGNGHSFWYDMMP

SEQ ID NO: 30206 - protein, 206 aa, Staphylococcus aureus
MKLFAFIFICVKSCSLLFMLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVFENERNSLSFDIPTNKKNITAQEIDYKVRNYLLKHKNLYEFNSSPYE

SEQ ID NO: 30207 - protein, 222 aa, Staphylococcus aureus
MKLFAFIFICVKSCSLLFMLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVFENERNSLSFDIPTNKKNITAQEIDYKVRNYLLKHKNLYEFNSSPYETGYIKFIEGNGHSFWY

SEQ ID NO: 30208 - protein, 281 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQTW

SEQ ID NO: 30209 - protein, 310 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKEEDNNKPGKEDGNKPGKEDNNKPGKEDGNKPGKEDNKKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30210 - protein, 450 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30211 - protein, 434 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKEEDNNKPGKEDGNKPGKEDNNKPGKEDNNKPGKEDGNKPGKEDNKKPGKEDNNKPGKEDGNKPGKEDDNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30212 - protein, 321 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKEEDNNKPGKEDNNKPGKEDGNKPGKEDGNKPGKEDNKKPGKEDGNKPGKEDGNKPGKEDGNKPGKEDGNKPGKEDGNKPGKEDGNKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30213 - protein, 257 aa, Staphylococcus aureus
MKKTAFTLLLFIALTWTTSPLVNGSEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 30214 - protein, 266 aa, Staphylococcus aureus
MYNRLFVSRVILIFALILVIYTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSEKTNDINSHQTDKRKTCMYGGVTEHNGNHLDKYRSITVRVFEDGKNLLSFDVQTNKKKVTAQELDYLTRHYLVKNKKLYEFNNSPYETGYIKFIESENSFWYDMMPAPGDKFDQSKYLMMYNDNKLVDSKDVKIEVYLTTKKK

SEQ ID NO: 30215 - protein, 410 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSVSKEILAEAKKLNDAQAPKEEDNKKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30216 - protein, 2186 aa, Staphylococcus aureus
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDNKNYQAQGNVIALGRINGTDTNDHGDFNGIEKTLTVNPNSELIFEFNTMTTKNGQGATNVIIKNADTNDTIAEKTVEGGPTLRLFKVPDNVRNLKIQFVSKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEGEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGMQNIVVIQPATQVKTDARNTVNEKAREAITNINATPGATREEKQEAIDRVNALKNRALTDIGVTSTTAMVNSIRDDAVNQIGAVQPHVTKKQTATGVLNDLATAKKQEINQNTNATTEEKQMALNQVDQDLATAINNINQADTNTEVDQAQQLGAQAINAIQPNIVKKPAALAQINQHYNAKLAEINATPDATDDEKNAAINTLNQDRQQAIESVKQANTNNEVDQAATTAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIARAAARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVEAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANFQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMIDEDATLNDIKQHTQFIVDEILAIKLPAEAMKVSPKVIQPAPKVCTPIKKEETHESRKVEKELPNTGSEGMDLPLKEFALITGAALLARRRTKNEKES

SEQ ID NO: 30217 - protein, 242 aa, Staphylococcus aureus
MKKLISILLINIIILGVSNNASAQGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKLVTAQEIDVKLRKYLQEEYNIYGHNGTKKGEEYGHKSKFYSGFNIGKVTFHLNNNDTFSYGLFYTGDDGLPKSFLKIYEDNKTVESEKFHLDVDISYKETI

SEQ ID NO: 30218 - protein, 227 aa, Staphylococcus aureus
ESQPDPTPDELHKSSEFTGTMGNMKYLYDDHYVSATKVMSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKS

SEQ ID NO: 30219 - protein, 233 aa, Staphylococcus aureus
SEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 30220 - protein, 234 aa, Staphylococcus aureus
GSNEEDPKIESLCKKSSVDPIALHNINDDYINNRFTTVKSIVSTTEKFLDFDLLFKSINWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 30221 - protein, 232 aa, Staphylococcus aureus
NKASEFSGLMDNMRYLYDDKHVSETNIKAQEKFLQHDLLFKINGSKIDGSKILKTEFNNKSLSDKYKNKNVDLFGTNYYNQCYFSADNMELNDGRLIEKTCMYGGVTEHDGNQIDKNNLTDNSHNILIKVYENERNTLSFDISTNKKNITAQEIDYKVRNYLLKHKNLYKFNSSPYETGYIKFIEGNGHSFWYDMMPESGEKFYPTKYLLIYNDNKTVESKSINVEVHLTKK

SEQ ID NO: 30222 - protein, 233 aa, Staphylococcus aureus
QPDPKLDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30223 - protein, 219 aa, Staphylococcus aureus
QGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKLVTAQEIDVKLRKYLQEEYDIYGHNGTKKGEEYGHKSKFYSGFNIGKVTFHLNNNDTFSYGLFYTGDDGLPKSFLKIYEDNKTVESEKFHLDVDISYKETI

SEQ ID NO: 30224 - protein, 65 aa, Staphylococcus aureus
MYNNDTLGGKIQRGKIEFDSSDGSKVSYDLFDVKGDFPEKQLRIYSDNKTLSTEHLHIDIYLYEK

SEQ ID NO: 30225 - protein, 179 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKMLPYKN

SEQ ID NO: 30226 - protein, 259 aa, Staphylococcus aureus
MLNKILLLLLSVTFMLLFFSLHSVSAKPDPRPGELNRVSDYKKNKGTMGNVESLYKDKAVIAENVKNTRQFLGHDLIFPIPYSEYKEVKSEFINKKTADKFKDKRLDVFGIPYFYTCLVPKNESREEFIFDGVCIYGGVTMHSTADSISKNIIVPVTVDNKQQFSFTISTNKKTVTVQELDYKVRNWLTNNKKLYEFDGSAYETGYIKFIEENKDSFWYDLFPKKDLVPFIPYKFVNIYGDNKTIDASSVKIEVHLTTT

SEQ ID NO: 30227 - protein, 250 aa, Staphylococcus aureus
MKELIVIVLLLSVSQIKDNTFQTSSEDLHHKSELSSLALNNMRHNYFHRWPPVKGENKITNDQFLANTLLFKDFLTNHQYYNDLLVQFNSKETTDKFKAKTVDIYGLAYGFQCNGGEPNKTNCIYGGLTTHEDNKLDKPKNVPINLWIDGAQKRVSLDKVKTDKKTVTIQELDAQARYFLQGEYLLYHNDSFGGKIQKGFIEFHDANGFEVSYDLFDVKGDYPDTQLRIYNDNKTISSKNLHIDIYLFTK

SEQ ID NO: 30228 - protein, 258 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 30229 - protein, 1016 aa, Staphylococcus aureus
MKKSKKRLDFLPNKLNKYSIRRFSVGTASILVGATLLFGINNEAHAAEQNETPVKEEATNDNSASEVSQETPVKEEATNNNSASEASQETPVKEEATNDNSASEASQETPVKEEATNNNSASEASQETPVKEEATNNNSASEASQETPVKEEVTNDNSASEASQETPVKEEATNDNSASETPDYVGVNSDSLENSTLENGDDESSNDQDKDIAYTTPTEATAPRSIEPRSRVALNEAQAQKQGKNVNDLITVTNQSITEGGREDGIISAHDGENITYTTDFKIDNDVKSGDTMTVKYDPRTIPSDLTDDYTPVDIMDPSGEVIATGSFDNSNKTTTYTFTDYVDKYENVNAKLVMNSFIDKKEVPNEETVDLTFATANESINKSFNVSYQRPIVERASNIQSIFTNLDLDGNTVEQTVYVNPLSLNAQNAKVLIRGAGVYDDGGFFNGEGSTIIDNSTDIKVYKAKPGQKLPQNNRIYDYSQYEDVTNQVNIDKNYSNNQAMVDFGNINSPYIIKVKSKYTPGAEDSLAIQQGVRMTTTNDGILSYAGYTNSIISTSDQGGGNGEEAPEKTYKIGDYVWEDVDKDGVQGTDEKEKPISNVLVTLTYPDGTSKSVRTDENGHYEFDNLYDGETYQVSFETPEGYEPTKVNAGNNSELDSNGSNVSVTINGSDDMTLDSGFYKTPKYSIGDYVWLDSNKDGVQDEEENGISGVTVTLKDKNGKTLQTTQTDGKGKYRFDNLDSGDYKVVFEKPEGLTQTATNSTNEDEDADGGEVDVTITDHDDFSIDNGYFEDDTDADADSDADADSDADADSDADSDADADSDADADSDSDADADSDADADSDADADSDADADSDADADSDADADSDADADSDADSDSDADADSDADADSDADSDSDADADSDADADSDADADSDADSDSDADADSDADADSDADSDSDADADSDADADSDADADSDADADSDSDADKGHNDKVNSKELPDTGNENNGTLFGSLFAALGGLFLVGRRRKNKNNEEK

SEQ ID NO: 30230 - protein, 268 aa, Staphylococcus aureus
MKKTIFILIFSLTLTLLITPLVYSDSKNETIKEKNLHKKSELSSITLNNLRHIYFFNEKGISEKIMTEDQFLDYTLLFKSFFISHSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFGGKIQKGLIVFHTSKEPLVSYDLFNVIGQYPDKLLKIYQDNKIIESENMHIDIYLYTSLIVLISLPLVL

SEQ ID NO: 30231 - protein, 67 aa, Staphylococcus aureus
MKQIDYRIKSYLVKKQQLYTEFYNGKIEISMLDGKKHFIDLSTYYYDPSNFTLDYTKISHFDIYMEK

SEQ ID NO: 30232 - protein, 257 aa, Staphylococcus aureus
MNYSKITVSLIIILLCTFSFEFSFNRFVQADESRPKIESLKKKSELDSTALYNIKTSYSQDNIILDIKNKTNSTQLLSNDLIFDDITLKEWNKNSLKTEFNSSEIANHFKGKKVDIFGIYYGANCIGEVSKRTGCIYGGITLHEEEKIDQKNSIGVNVFKDGSQQKGFMITTDKKEPTIQELDLKTRKVIQNQYKIYNSETGNIQKGYMEFHSNSSSFYYDLFNFKGKYSVDFLKFYNDNKTINSSNLHIDVYLYSQ

SEQ ID NO: 30233 - protein, 55 aa, Staphylococcus aureus
MKVINTYSIRKCNIGVASFIIGSFLFLGVNGNLAEANDERQEVDNGQQELLKKNK

SEQ ID NO: 30234 - protein, 73 aa, Staphylococcus aureus
MILKHKIFTSQLILSISEKTRSITRQYADYQFPILKEEIPLKKLDFQSRNILIKNYGVYKENKFANCKIKLDK

SEQ ID NO: 30235 - protein, 413 aa, Staphylococcus aureus
MENKNNRYSIRKFSVGVGSILIASFIMIFQNEAHASEKAIETPKEEKAIETPKNSNDLKFLKDAKFSSDSENLDIRLRPEYNVGNALVVRVDKEINPEKFVDYPEGYTVQSYVSKGSDYPSVEKIVKNKITGMYKITYTLMDKAGNPVNGSDGQVVIRSLNIYFYDPTPVLESIDKVNKKIKDGNYSNGDEVKKELDKIRVDIERPKEIPNIKEFLSKVDMEEKKLKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNNYKNEKLLPNTGMKQEGKNTAFSSIIIILMASMLFINKRRKKENKEI

SEQ ID NO: 30236 - protein, 545 aa, Staphylococcus aureus
MENKNNRYSIRKFSVGVGSILIASFIMIFQNEAHASEKAIETPKEEKAIETPKEEKAIETPKEEKAIETPKEEKAIETPKEEKAIETPKEEKAIETPKNSNDLKFLKDAKFSSDSENLDIRLRPEYNVGNALVVRVDKEINPEKFVDYPEGYTVQSYVSKGSDYPSVEKIVKNKITGMYKITYTLMDKAGNPVNGSDGQVVIRSLNIYFYDPTPVLESIDKVNKKIKDGNYSNGDEVKKELDKIRVDIERPKEIPNIKEFLSKVDMEEKKLKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNNYKNEKLLPNTGMKQEGKNTAFSSIIIILMASMLFINKRRKKENKEI

SEQ ID NO: 30237 - protein, 258 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDKTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 30238 - protein, 1189 aa, Staphylococcus aureus
MKNLNSKCGRTLSRFSIRKCSVGTASFLIGTVAFFGIHHEAFAAENSKTPVPVTQLLENSNKESTEEKTDLQTNENETLQGGVSNNTLNREVEKENVNGIQEKPNAQKEEKTLSDSQLTRSSQQDNSTTTASPQTNDHQLPIKHDTSYEKSTSNSTLNEQPMEPTPFPNNTVKTEEVGATQNAATVPLQLQTVKGTKQLRAVNTAAVTPAVSGGTNVNDKVTASNMDISESYIEPNNSGSFYLNSRFTVNGTVKEGDYFTVKMPNAVNTYGDTRYYSDFREELKNSNGDVIALGEYDVASHTLTYKFTSTVNNLQNVTGSFNLTQFMDRQVAKTSDTYPLKYEIAGESFNTQIKVHYGQYHHIGDSNLKSMITMEDSKTGEYEQYIYVNPLKKDAYGTVVRVKGFSNNLSDSNGQVNPDTTQIKILKVDEKQDLNDSFGVDDSQYEDVTNQFKTVYDENNLADIHFGDLHGARYIIKVTSKEKEDSSADLKLSSSMYTKNRYGQYDRITWDNHIVKSSSSGNADGTEVSYQLGDKVWNDANKNGIQDAGEFGIPGVKVILKDKDGNFLEKTETNANGKYVFDNLSNGIYTVDFEAPEGYTASPQNQGNDALDSDGPTSAHAIISDGNNLTIDQGFYLTEPPVPTTHNIGDKVWEDLNKDGIQDDNEPGISNVKVTLTDSDGNVVDTRKTDDKGNYLFEDVKAGDYIVTFETPEGFTPTQTGQGTIDNDSNGTSTKVTVGDSDDLSLDSGFYKTPKYNLGNYVWEDTNKDGKQDSTEKGISGVTVTLKNENGEVLQTTKTDKDGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDKDHNDKTDKSNNKELPDTGNDVPNNDTLFGSLFATLGGLFLIGRRRKNKNNNAEK

SEQ ID NO: 30239 - protein, 520 aa, Staphylococcus aureus
MKKNFQMKVINTYSIRKCNIGVASFIIGSFLFLGVNGNLAEANDERQEVDNGQQQKLNEADNERQEVDNGQQQKLNEANNERQEVDNGQQQKLNEANNERQEVDNGQQQKLNEANNERQEVDNGQQQKLNEANNERQEVDNGQQQKLNEANNERQEVDNGQQQKLNEANNERQEVDNGQQELLKKINESTNRESTVKRLLEDVYSKENARGILNKIKPEDYNLSSNELINKIIKAGIDYSEENNSKYKVFASVPKANITLKSEYNIGNSLVVRSDKVIKPEDYVNYPEGYHVQSYVSKGKEYPSLDDIVKKRVTGSYKITYRLLDSKDEPVYGEDGQAIVRSLNVYFYNPEPALDIIKEIEEDIDENNYQNGEEIKEGLEKIKNELERPTKIPDVPALIDEINNKKNQLENLDTTAPDAPKVKDTESGSKKITGEGSEPGNDITVTFPSGKTSQGKVGQDGQWEVDVPAGEELKPGDKVTAKETDPSGNESSLPNTGKTKGDFANVILFILGLVLLFKRK

SEQ ID NO: 30240 - protein, 256 aa, Staphylococcus aureus
MFILKRPIVLVVLFFVLYVLISPNSNAISNSVPSTLHNKSELDTTQLYNLSNFYKSAEWHTDIHNKVNKNQLLATDLIFGDIHQSSLMTNALKVEFQNSALASQFKDKKVDIYGISFANNCIGLVGDKTSCMYGGITIHDNNQLEGEKNIGINVFKDGSKHETFTIATKKKMVTLQELDIKTRNKLEQSFNIYNKDKGDIKKGYINYHPHNQNDNNYYYDLYDFKGKLSEQFFRFYNDNIIVPSSAYHIDVYLFSN

SEQ ID NO: 30241 - protein, 243 aa, Staphylococcus aureus
MPYFKKVFLLFALFFFSIQSFYNTAKADAGVLNLRNFYGSYSFEDHKSIDTLNNPLTHELTFNMGNYQLNSEMQNDFDVAKFKGKKVDIFGISYKGVCGTNYMYGGVTKSDNNLKQKRNIPINLSVNGENKTVVTERISTDKKMVTVQEIDVKLRKYLQDEYNIYGHNKTNKGKQYGTKSKFYSGFDTGTIVFHMNDGNNFSYDLFDYGHGQPEDFLKIYKDNKTIDSEVFHLDVEISFLGKE

SEQ ID NO: 30242 - protein, 708 aa, Staphylococcus aureus
MENKNNRYSIRKFSVGVGSILIASFIMIFQNEAHASEKAIETPKEEKAIETLKEEKAIETPKEEKAIETPKEEKAIETPKEKKAIETPKEEKAIETPKEKKAIETPKEEKAIETPKNSNDLKFLKDAKFSSDSENLDIRLRPEYNVGNALVVRVDKEINPEKFVDYPEGYTVQSYVSKGSDYPSVEKIVKNKITGMYKITYTLMDKAGNPVNGSDGQVVIRSLNIYFYDPTPVLESIDKVNKKIKDGNYSNGDEVKKELDKIRVDIERPKEIPNIKEFLSKVDMEEKKLKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNWTVDVPEGTELKVGNEITATETDMSGNKSESGKGKVTDTTAPEAPSVNDTEVGSKKVSGKGHEVGNTVTVTFPDGKTATSKVDEKGNNYKNEKLLPNTGMKQEGK

SEQ ID NO: 30243 - protein, 134 aa, Staphylococcus aureus
MKNKINKIAISSMIFGGTLLTSNFNLYAEEGINTSVSKSLDLDQSGKLDHGILHPDGTVTNPNVSPNHYILEVEKSMEFQDATNSNEQSTISHDHKLPETGEQSSNLSIITFLASLTLIIGILLTFRRFIKPIK

SEQ ID NO: 30244 - protein, 1167 aa, Staphylococcus aureus
MTQLLENSNKESTEEKTDLQTNENETLQGGVSNNTLNREVEKENVNGIQEKPNAQKEEKTLSDSQLTRSSQQDNSTTTASPQTNDHQLPIKHDTSYEKSTSNSTLNEQPMEPTPFPNNTVKTEEVGATQNAATVPLQLQTVKGTKQLRAVNTAAVTPAVSGGTNVNDKVTASNMDISESYIEPNNSGSFYLNSRFTVNGTVKEGDYFTVKMPNAVNTYGDTRYYSDFREELKNSNGDVIALGEYDVASHTLTYKFTSTVNNLQNVTGSFNLTQFMDRQVAKTSDTYPLKYEIAGESFNTQIKVHYGQYHHIGDSNLKSMITMEDSKTGEYEQYIYVNPLKKDAYGTVVRVKGFSNNLSDSNGQVNPDTTQIKILKVDEKQDLNDSFGVDDSQYEDVTNQFKTVYDENNLADIHFGDLHGARYIIKVTSKEKEDSSADLKLSSSMYTKNRYGQYDRITWDNHIVKSSSSGNADGTEVSYQLGDKVWNDANKNGIQDAGEFGIPGVKVILKDKDGNFLEKTETNANGKYVFDNLSNGIYTVDFEAPEGYTASPQNQGNDALDSDGPTSAHAIISDGNNLTIDQGFYLTEPPVPTTHNIGDKVWEDLNKDGIQDDNEPGISNVKVTLTDSDGNVVDTRKTDDKGNYLFEDVKAGDYIVTFETPEGFTPTQTGQGTIDNDSNGTSTKVTVGDSDDLSLDSGFYKTPKYNLGNYVWEDTNKDGKQDSTEKGISGVTVTLKNENGEVLQTTKTDKDGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDKDHNDKTDKSNNKELPDTGNDVPNNDTLFGSLFATLGGLFLIGRRRKNKNNNAEK

SEQ ID NO: 30245 - protein, 68 aa, Staphylococcus aureus
MLSYPDSDAGKHTPVKPMSTTKDHHNKAKALPETGSENNGSNNATLFGGLFAALGSLLLFGRRKKQNK

SEQ ID NO: 30246 - protein, 1261 aa, Staphylococcus aureus
MKNLNSKCGRTLSRFSIRKCSVGTASFLIGTVAFFGIHHEAFAAENSKTPVPVTQLLENSNKESTEEKTDLQTNENETLQGGVSNNTLNREVEKENVNGIQEKPNAQKEEKTLSDSQLTRSSQQDNSTTTASPQTNDHQLPIKHDTSYEKSTSNSTLNEQPMEPTPFPNNTVKTEEVGATQNAATVPLQLQTVKGTKQLRAVNTAAVTPAVSGGTNVNDKVTASNMDISESYIEPNNSGSFYLNSRFTVNGTVKEGDYFTVKMPNAVNTYGDTRYYSDFREELKNSNGDVIALGEYDVASHTLTYKFTSTVNNLQNVTGSFNLTQFMDRQVAKTSDTYPLKYEIAGESFNTQIKVHYGQYHHIGDSNLKSMITMEDSKTGEYEQYIYVNPLKKDAYGTVVRVKGFSNNLSDSNGQVNPDTTQIKILKVDEKQDLNDSFGVDDSQYEDVTNQFKTVYDENNLADIHFGDLHGARYIIKVTSKEKEDSSADLKLSSSMYTKNRYGQYDRITWDNHIVKSSSSGNADGTEVSYQLGDKVWNDANKNGIQDAGEFGIPGVKVILKDKDGNFLEKTETNANGKYVFDNLSNGIYTVDFEAPEGYTASPQNQGNDALDSDGPTSAHAIISDGNNLTIDQGFYLTEPPVPTTHNIGDKVWEDLNKDGIQDDNEPGISNVKVTLTDSDGNVVDTRKTDDKGNYLFEDVKAGDYIVTFETPEGFIPTQTGQGTIDNDSNGTSTKVTVGDSDDLSLDSGFYKTPKYNLGNYVWEDTNKDGKQDSTEKGISGVTVTLKNENGEVLQTTKTDKDGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDKDHNDKTDKSNNKELPDTGNDVPNNDTLFGSLFATLGGLFLIGRRRKNKNNNAEK

SEQ ID NO: 30247 - protein, 380 aa, Staphylococcus aureus
MENKNNRYSIRKFSVGVGSILIASFIMIFQNEAHASEKAIETPKEEKAIETPKEEKAIETPKEEKAIETPKEEKAIETPKEEKAIETPKEKKAIETPKEEKAIETPKNSNDLKFLKDAKFSSDSENLDIRLRPEYNVGNALVVRVDKEINPEKFVDYPEGYTVQSYVSKGSDYPSVEKIVKNKITGMYKITYTLMDKAGNPVNGSDGQVVIRSLNIYFYDPTPVLESIDKVNKKIKDGNYSNGDEVKKELDKIRVDIERPKEIPNIKEFLSKVDMEEKKLKVTDTTAPEAPSVNDTEVGSKKVSGKGHEVGNTVTVTFPDGKTATSKVDEKGNNYKNEKLLPNTGMKQEGKNTAFSSIIIILMASMLFINKRRKKENKEI

SEQ ID NO: 30248 - protein, 172 aa, Staphylococcus aureus
MKTKQLLSTTAIAGTLLLTGLNAPQAKAESNINGSNAVDIIQQVDKQHGNQPDLIRYGQPKDHGDYYEVTTNNKSGVGGTGITRLYKDGTVKHSTDSSGQDFKTFGHYEDTSSHDQNTTQAATQHTETSQHDTTNQTLPETGQSHTGITTMVGIVALMAGIGFIARRASHKA

SEQ ID NO: 30249 - protein, 231 aa, Staphylococcus aureus
MKLKTLAKATLALGLLTTGVITSEGQAVQAAEKQGRVQHLHDIRDLHRYYSSESFEYSNVSGKVENYNGSNVVRFNPKDQNHQLFLLGKDKEQYKEGLQGQNVFVVQELIDPNGRLSTVGGVTKKNNKTSETNTPLFVNKVNGEDLDASIDSFLIQKEEISLKELDFKIRQQLVNNYGLYKGTSKYGKIIINLKDENKVEIDLGDKLQFERMGDVLNSKDIRGISVTINQI

SEQ ID NO: 30250 - protein, 103 aa, Staphylococcus aureus
KPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30251 - protein, 51 aa, Staphylococcus aureus
TGGNGSFNYSKTISYNQQNYISEVEHQNSKSVQWGIKANSFITSLGKMSGH

SEQ ID NO: 30252 - protein, 216 aa, Staphylococcus aureus
DVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDAENFHLDVEISYEKTE

SEQ ID NO: 30253 - protein, 70 aa, Staphylococcus aureus
SDYYPRNSVDTKEYMSTLTYGFNGNVTGDDTGKIGGLIGANVSIGHTLKYVQPDFKTILESPTDKKVGWK

SEQ ID NO: 30254 - protein, 53 aa, Staphylococcus aureus
GSGDTSEFEITYGRNMDVTHATRRTTHYGNSYLEGSRIHNAFVNRNYTVKYEV

SEQ ID NO: 30255 - protein, 212 aa, Staphylococcus aureus
MGNVESLYKDKAVIAENVKNTRQFLGHDLIFPIPYSEYKEVKSEFINKKTADKFKDKRLDVFGIPYFYTCLVPKNESREEFIFDGVCIYGGVTMHSTADSISKNIIVPVTVDNKQQFSFTISTNKKTVTVQELDYKVRNWLTNNKKLYEFDGSAYETGYIKFIEENKDSFWYDLFPKKDLVPFIPYKFVNIYGDNKTIDASSVKIEVHLTTT

SEQ ID NO: 30256 - protein, 158 aa, Staphylococcus aureus
MAQHFKSKNVDVYAIRYSINCYGGEIDKTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 30257 - protein, 128 aa, Staphylococcus aureus
NIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIG

SEQ ID NO: 30258 - protein, 155 aa, Staphylococcus aureus
MLNIKNKKLIAFVIILLFICLLCFIFKSNTIKLDKDESVEMSGYKISYNDYPTEYKSKVRVHMRIENLKNKDNPLKPNETFKLITDGKEAEMVEFANSKEYIKSTSFSPRMTVTLDMIYKIEDNPKSYKLQMRDKKLLKDKVYEYDITADISKIN

SEQ ID NO: 30259 - protein, 257 aa, Staphylococcus aureus
MKKTAFTLLLFIALTLTTSPLVNGSEKSEEINEKDLRKKSELQGTALGNLKQIYYYNEKAKTENKESHDQFLQHTILFKGFFTDHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQYSNTLLRIYRDNKTINSENMHIDIYLYTS

SEQ ID NO: 30260 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30261 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30262 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30263 - protein, 559 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30264 - protein, 559 aa, Staphylococcus aureus
MNMKKKEKHAIRKKSIGVASVLVGTLIGFGLLSSKEADASENSVTQSDSASNESKSNDSSSINAAPKTDNTNVSDTKPTSNTNNGETSVAQNPAQQETTQSASTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30265 - protein, 559 aa, Staphylococcus aureus
MNMKKKEKHAIRKKSIGVASVLVGTLIGFGLLSSKEADASENSVTQSDSASNESKSNDSSSINAAPKTDNTNVSDTKTTSNTNNGETSVAQNPAQQETTQSASTNATTEETPVTGETTTTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30266 - protein, 559 aa, Staphylococcus aureus
MNMKKKEKHAIRKKSIGVASVLVGTLIGFGLLSSKEADASENSVTQSDSASNESKSNDSSSVNAAPKTDNTNVSDTKTTSNTNNGETSVAQNPAQQETIQSASTNATTEETPVTGEATTTATKQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30267 - protein, 559 aa, Staphylococcus aureus
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30268 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTFNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30269 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30270 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDTKNDVKATLTVPAYIDPENVTKTGNVTLKTGIGTNTDSKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30271 - protein, 558 aa, Staphylococcus aureus
MNMKKKEKHAIRKKSIGVASVLVGTLIGFGLLSSKEADASENSVTQSDSASNESKSNDSSSVNAAPKTDNTNVSDTKTTSNTNNGETSVAQYLAQQETTQSVSTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDNDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFPTDDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30272 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQNTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30273 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSLTNATTEETPVTGEATTATNQANTPATTQSSNTNAEELVNQTSNETTSNDTNTVSSVNSPQNSTNAENVSTTQDTSTEATPSNNESAPQSTDASNKDLVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30274 - protein, 558 aa, Staphylococcus aureus
MNMKKKEKHAIRKKSIGVASVLVGTLIGFGLLSSKEADASENSVTQSDSASNESKSNDPSSVNAAPKTDNTNVSDTKTSSNTNNGETSVAQNPAQQETTQSSLTNATTEETPVTGEATTATNQANTPATTQSSNTNAEELVNQTSNETTSNDTNTVSSVNSPQNSTNAENVSTTQDTSTEATPSNNESAPQSTDASNKDLVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30275 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNLAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30276 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTVPAYIDPENVTKTGNVTLTTGIGTNTASKTVLIDYEKYGQFHNLSIKGTIDQIDKTNNTYRQTIYVNPSGDNVVLPVLTGNLIPKSNSNALIDANNTNIKVYKVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30277 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQNTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKAPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30278 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGDTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30279 - protein, 559 aa, Staphylococcus aureus
MNMKKKEKHAIRKKSIGVASVLVGTLIGFGLLSSKEADASENSVTQSDSASNESKSNDSSSVSAAPKTVDTNVSDTKTTSNTNSGETSVAQNPAQQETTQSASTNATTEETPATGEATTTATNQANTPATTQSSNTNAEELVNQTNNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30280 - protein, 559 aa, Staphylococcus aureus
MNMKKKEKHAIRKKSIGVASVLVGTLIGFGLLSSKEADASENSVTQSDSASNESKSNNPSSVNAAPKTDNTNVSDTKTTSNTNNSETSVAQNPAQQETTQSASTNATTEETPVTGEGTTTATNQANTPAATQSNNTNAEELVNQTSNETTSNDTNTVSSVNSPQNSTNAENVSTTQDTSTEATPSNNESAPQSTDASNKDVVSQAVNPSAPRMRAFSLAAVAADAPAAGTDITNQLTDVTVGIESGDTVYPHQAGYVKLNYGFSVPNSAVKGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQVDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30281 - protein, 559 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGFGDGIDKPVVPEQPDEPGEIEPIPE

SEQ ID NO: 30282 - protein, 559 aa, Staphylococcus aureus
MNMKKKEKHAIRKKSIGVASVLVGTLIGFGLLSSKEADASENSVTQSDSASNESKSNDSSSINAAPKTDNTNVSDTKTTSNTNNGETSVAQNPAQQETTQSASTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGKDITNQLTNVTVGIDSGDTVYPHQAGYVKLNYGFSVPNEAVQGDTFKIAVPKELNLNGVTSTAKVPPIMAGDKVLANGVIDSDGNVIYTFTDYVDTKENVTANITMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30283 - protein, 559 aa, Staphylococcus aureus
MNMKKKEKHAIRKKSIGVASVLVGTLIGFGLLSSKEADASENSVTQSDSASNESKSNDSSSVNAAPKTDNANLSDTKTTSNSNNGETSVAQNPAQQETTQSASTNATTEETPATGEATTTATNQANTPATTQSSNTNAEELVNQTSNETTSNDTNTVSSVNSPQNSTNAENVSTTQDTSTEATPSNNESAPQSTDASNKDVINQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTDSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30284 - protein, 559 aa, Staphylococcus aureus
MNMKKKEKHAIRKKSIGVASVLVGTLIGFGLLSSKEADASENSVTQSDSASNESKSNDSSSVNAAPKTDNANLSDTKTTSNSNNGETSVAQNPAQQETTQSASTNATTEETPATGEATTTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDKVLANGVIDSDGNVIYTFTDYVDTKENVTANITMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30285 - protein, 559 aa, Staphylococcus aureus
MNMKKKEKHAIRKKSIGVASVLVGTLIGFGLLSSKEADASENSVTQSDSASNESKSNDSSSVNAAPKTDNTNVSDTKTTSNTNNGETSVAQNPAQQETIQSASTNATTEETPVTGEATTTATKQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTINQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30286 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSASTNATTEETPATGEATTTATNQANTQATTQSSNTNAEELVNQTNNETTSNDTNTVSSVNSPQNSTNAENVSTTQDTSNETTPSNNESAPQNTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30287 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGDTVYPHQAGYVKLNYGFSVPNSAVKGDTFKTTVPKELNLNGVTSTAKVPPIMAGDQVLANGVIDSDGNVIYTFTDYVNTKDDVKATLTMPAYIDPENVTKTGNVTLATGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30288 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEGVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30289 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEVTPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30290 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTTSNTNSGETSVAQNPAQQETTQSASTNVTTEENPATGEATTTATDQANTQATTQSSNTNAEELVNQTNNETTSNDTNTVSSVNSPQNSTNAENVSTTQDTSTEATPSNNESAPQSTDASNKDVVSQAVNPSTPRMRAFSLAAVAADAPAAGTDITNQLTDVTVGIDSGTTVYPHQAGYVKLNYGFSVPNSAVKGDTFKITVPKELNLNGVTSTAKVPPIMAGDQVLANGVIDSDGNVIYTFTDYVDTKNDVKATLTVPAYIDPENVTKTGNVTLTTGIGTNTASKTVLIDYEKYGQFHNLSIKGTIDQIDKTNNTYRQTIYVNPSGDNVVLPVLTGNLIPKSNSNALIDANNTNIKVYKVDNADDLSHSYYVNPNDFEDVTDQVRISYPNDNQYKVEFPTDDDQITSPYIVVVNGHIDPNSKGDLALRSTLYGYDSRFVWRSMSWDNEVAFNNGSGSGDGIDKPVVPEQPDEPGEIEPIPE

SEQ ID NO: 30291 - protein, 558 aa, Staphylococcus aureus
MNMKKKEKHAIRKKSIGVASVLVGTLIGFGLLSSKEADASENSVTQSDSASNESKSSDSSSVNAAPKTDNTNVSDTKTTSNTNNGETSVAQNPAQQETTQSASTNATTEETPVTGETTTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKENVTANITMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30292 - protein, 558 aa, Staphylococcus aureus
MNMKKQEKHAIRKKSIGVASVLVGTLIGFGLLSSKEADASENSVTQSDSASNESKSNDPSSVNAAPKTDNTNVSDSNTTTNTNSDETNVAQNPAQQETTQSASTNATTEETPVTGEATTATNQANTPATTQSSNTNAEELVNQTSNETTSNDTNTVSSVNSPQNSTNAENVSTTQDTSTEATPSNNESAPQSKDASNKDVVNQAVNTSAPRMRAFSLAAVAADAPATGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVNTKDDVKATLTMPAYIDPENVTKTGNVTLTTGIGTNTDSKTVLIDYEKYGQFHNLSIKGTIDQIDKTNNTYRQTIYVNPSGDNVVLPALTGNLIPNTKSNALIDAKNTDIKVYRVDNANDLSESYYVNTSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30293 - protein, 559 aa, Staphylococcus aureus
MNMKKKEKHAIRKKSIGVASVLVGTLIGFGVLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30294 - protein, 559 aa, Staphylococcus aureus
MNMKKKEKHAIRKKSIGVASVLVGTLIGFGLLSSKEADASENSVTQSDSASNESKSNDSSSINAAPKTDNTNVSDTKTTSNTNNGETSVAQNPAQQETTQSSSTNATAEETPVTGEATTTTTNQANTPATTQSSNTNAEELVNQTSNETTSNDTNTVSSVNSPQNSTNAEKVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGSNTASKTVLIDYEKYGQFHNLSIKGTIDQIDKTNNTYRQTIYVNPSGDNVVLPVLTGNLIPKSNSNALIDANNTNIKVYKVDNADDLSHSYYVNPNDFEDVTDQVRISYPNDNQYKVEFPTDDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30295 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEETPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30296 - protein, 559 aa, Staphylococcus aureus
MNMRKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30297 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRVFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTVPAYIDPENVTKTGNVTLTTGIGTNTASKTVLIDYEKYGQFHNLSIKGTIDQIDKTNNTYRQTIYVNPSGDNVVLPVLTGNLIPKSNSNALIDANNTNIKVYKVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30298 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVN

SEQ ID NO: 30299 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVN

SEQ ID NO: 30300 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPESLTGNGDVDYSNSNNTMPIADIKSTNGNVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVN

SEQ ID NO: 30301 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30302 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30303 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYYTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30304 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVN

SEQ ID NO: 30305 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30306 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDNTGKNLKTQVIQENIDPATGKDYSIFGWNNENVVRYGGGSADGDSAVN

SEQ ID NO: 30307 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30308 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNGQVTASDFKLEKTTFDPNQSGNTFMAAKFTVTGQVKAGDYFTAKLPDSVNGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVYVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30309 - protein, 542 aa, Staphylococcus aureus
MKKRIDYLSNRQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30310 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNDQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVN

SEQ ID NO: 30311 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNCELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30312 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVN

SEQ ID NO: 30313 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTDQFKNRIYYEHPNVASINFGDITKTYVVLVEGHYDNTGKNLKTQVIQENIDPATGKDYSIFGWNNENVVRYGGGSADGDSAVN

SEQ ID NO: 30314 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANNIATNSGLKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGDVVATATYNILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30315 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGDVVATATYNILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30316 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30317 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDLKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDSATGKDYSIFGWNNENVVRYGGGSADGDSAVN

SEQ ID NO: 30318 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKDTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30319 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNATANDTSDISANTNSANVDSTAKPMSTQTSNTTTIEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGNVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30320 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNITTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYFTAKLPDSLTGNGDVDYSNSNNTMPIADIKSTNGDVVAKATYDILTKTYTFVFTDYVNDKQNINGKFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30321 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGINVNDKVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTDQFKNRIYYEHPNVASINFGDITKTYVVLVEGHYDKTGKNLKTQVIQENVDPATGKDYSIFGWNNENVVRYGGGSADGDSAVN

SEQ ID NO: 30322 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKGKITYKYQNVASINFGDINKTYVVLVEGHYDKTGKNLKTQVIQENVDPATGKDYSIFGWNNENVVRYGGGSADGDSAVN

SEQ ID NO: 30323 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNEKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30324 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLSQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTNEFNNRIFYEHPNVASINFGDINKTYVVLVEGHYDNTGKNLKTQVIQENIDPATGKDYSIFGWNNENVVRYGGGSADGDSAVN

SEQ ID NO: 30325 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNNTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIVNDKNEVVAKATYDILTKTYTFVFTDYVNDKQNINGKFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30326 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30327 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFVDITKTYVVLVEGHYDNTGKNLKTQVIQENVDPVTNRDYSIFGWNNENVVRYGGGSADGDSAVN

SEQ ID NO: 30328 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDRIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30329 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNYKVTAKDFQLEKTIFDPNQSGNTFMAANFTVTGQVKSGDYFTAKLPESLTGNGDVDYSNSNNTMPIADIKSTNGNVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVN

SEQ ID NO: 30330 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNYKVTAKDFQLEKTTFDPNQSGNTFMAANFTVTGQVKSGDYFTAKLPESLTGNGDVDYSNSNNTMPIADIKSTNGNVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVN

SEQ ID NO: 30331 - protein, 542 aa, Staphylococcus aureus
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDRATAAKMQDQTVPQEANSQVDNKTTNDANSIATNSELKNPQTLDLPQSSPQTISNAQGTSKPSVRTRAVRSLAVAEPVVNAADAKGTNVNGQVTASDFKLEKTAFDPNQSGNTFMAANFTVTGQVKSGDYFTAKLPESLTGNGDVDYSNSNNTMPIADIVNDKKDVVAKATYDILTKTYTFVFTDYVNDKENINGQFSLPLFTDRAKAPKSGTYPANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFNNRIFYEHPNVASINFGDITKTYVVLVEGHYDNTGKNLKTQVIQENVDLATGKDYSIFGWNNENVVRYGGGSADGDSAVN

SEQ ID NO: 30332 - protein, 542 aa, Staphylococcus aureus
MKKRIDYLSNKQNKYSIRRFTVGTTSVIVGATILFGIGNHQAQASEQSNDTTQSSKNNASVDSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNGQVTASDFKLEKTTFDPNQSGNTFMSANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGIYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVN

SEQ ID NO: 30333 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNGQVTASDFKLEKTTFDPNQSGNTFMAAKFTVTGQVKAGDYFTAKLPDSVNGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVN

SEQ ID NO: 30334 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLLQSSPQTISNAQGTSKPSVRTRAVRSLAVAEPVVNAADAKGTNVNDKVTASNLQLQKTTFDPNQSGNTFMAVNFKVAGKVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENVDPATGKDYSIFGWNNENVVRYGGGSADGDSAVN

SEQ ID NO: 30335 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTDQFKNSIYYEHPNVASINFGDITKTYVVLVEGHYDNTGKNLKTQVIQENIDPATGKDYSIFGWNNENVVRYGGGSADGDSAVN

SEQ ID NO: 30336 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVVEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30337 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYSDPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30338 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPGSTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30339 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKIQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30340 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVD

SEQ ID NO: 30341 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAEKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30342 - protein, 542 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVKPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 30343 - protein, 203 aa, Staphylococcus aureus
MFKKYDSKNSIVLKSILSLGIIYGGTFGIYPKADASTQNSSSVQDKQFQKVEEVPNNSEKALVKKLYDRYSQNTINGKSNKSRNWVYSERPLNENQVRIHLEGTYTVAGRVYTPKRNITLNKEVVTLKELDHIIRFAHISYGLYMGEHLPKGNIVINTKNGGKYTLESHKELQKDRENVKIKTDDIKNVTFELVKRVNDIEQV

SEQ ID NO: 30344 - protein, 203 aa, Staphylococcus aureus
MFKKHHSKNSILLKSILSLGIIYSGSLGIYSKANASTQNSSSVHDKQLQKVEEVPNNSEKALVKKLYDRYSKNTINGKSNKSRNWVYSERPLNGNQVRIHLEGTYTVAGRVYTPKRNITLNKEVVTLKELDHIIRFAHISYGLYMGEHLPKGNIVINTKNGGKYTLESHKELQKDRENVKINTDDIKNVTFELVKSVNDIEQV

SEQ ID NO: 30345 - protein, 203 aa, Staphylococcus aureus
MFKKYDSKNSIVLKSILSLGIIYSGSFGIYPKADASTQNSSSVQDKQLQKVEEVPNNSEKALVKKLYDRYSKDTINGKSNKSRNWVYSERPLNENQVRIHLEGTYTVAGRVYTPKRNITLNKEVVTLKELDHIIRFAHISYGLYMGEHLPKGNIVINTKNGGKYTLESHKELQKNRENVEINTDDIKNVTFELVKSVNDIEQV

SEQ ID NO: 30346 - protein, 203 aa, Staphylococcus aureus
MFKKNDSKNSIVLKSILSLGIIYGGTFGIYPKADASTQNSSSVQDKQLQKVEEVPNNSEKALVKKLYDRYSQNTINGKSNKSRNWVYSERPLNENQVRIHLEGTYRVADRVYTPKRNITLNKEIVTLKELDHIIRFAHISYGLYMGEHLPKGNIVINTKNGGKYTLESHKELQKDRENVKINTDDIKNVTFELVKSVNDIEQV

SEQ ID NO: 30347 - protein, 203 aa, Staphylococcus aureus
MFKKHHSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYRVADRVYTPKRNITLNKEVVTLKELDHIIRFAHISYGLYMGEHLPKGNIVINTKNGGKYTLESHKELQKDRENVKINTDDIKNVTFELVKSVNDIEQV

SEQ ID NO: 30348 - protein, 119 aa, Staphylococcus aureus
SLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30349 - protein, 297 aa, Staphylococcus aureus
AESKKDDTDLKFFSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNFNKGTPRSKDMLKNLNVNDVLYAGHNSTWDPQSNSIAKYNYPNGKPEHLDYIFTDKDGEQPKQLVNEVVTEKPKPWDVYAFPYYYVYNDFSDHYPIKAYSK

SEQ ID NO: 30350 - protein, 1604 aa, Staphylococcus aureus
MYSYVFYKKEDVYEKNKLDFLPNKLNKYSIRKFTVGTASLLIGATLVFGIGNEAKADEVSTSTEQVSSGDKNSDNTENMTSAQSTELENTPSTEESTKEEQPSAEEVGKEAQSSTEESTKEEQPSAEEVGKEAQSSTEESTKEEQPSAEEVGKEAQSSTEESTKEEQPSAEEVGKEAQSSTEESTKEEQPSAEEVGKEAQSSTEESTKEEQPSAEEVENDTSDISQVKDEATAATYYKEVANVSDEKAEEVIRDLGLDTESMSEQELQLALIKYLANKQKESQPLATALRAASPNNSESINVASNELINTLAVSSNEIIDADAIASGKITKGSDLQVTKGIVSGWLDVATNNYTPGVNGSQTALNDYKVYLQWMDKDGTVSPVYQATTHDLGGTRAGQGGNGTYAFDIGDGWTDANGKLHKPDFQSVSRQKYKMWLAPGQKSENGNEYFTYRKQPGNSTGFSGAVVPTGEFILANHSIQRTAVYVYEKPSNVTMTTPESEWKYDDKGPDSNPSYLPDSINKKDRYAVSGKVWWETTTTGTTYPTSAGESFVDQTLEEAKDGFRVVTSVLTPEGKQALSTTNGIDDVNERIKAQQELIKTNPEYIQQTVVAPIVDGSYTARFDDKFDVNYMYQYVMDKDGNVVPGYTGYSSPVFTSPNDYAGSVPFIASNNSYAYNVHFALVADPAKYDIDITNFDAIDNIAHPGDTAISNVSSMYYPGEKTEIVWLDTSGDKPVELSRTEVNNEAEAEQAAQFTVPEDIDSRKTYTVQLVVNGNVIGADSFAADNIVQPEIDPIDDQTVVEGNPITEVNVNTNKPDAEVTVEGLPEGVTYDPETGIISGTPVVNDWKDNWDPSNSSASTFEEERDFPVTVTLTDENGTTTSEDFVIKVQRDTDKDGNPDINDNDDDGDGVQDDDEINESTNPKDSENHLGDNDRYDPTVEEVNKDHGTPTTEEDVTGAVTVPDYPSEGEQPVITVDDPNQLPDGNTPGTTEVDVTVTYPDGTTDHIKVPVTVGEQADNDAYEPTTDGVTKDHGTPTTEEDVTGAVTVPDYPSEGEQPVITVDDPNQLPDGNTPGTTEVDVTVTYPDGTTDHIKVPVTVGEQADNDAYEPTTDGVTKDHGTPTTEEDVTGAVTVPDYPSEGEQPVITVDDPNQLPDGNTPGTTEVDVTVTYPDGTTDHIKVPVTVGEQADNDAYEPTTDGVTKDHGTPTTEEDVTGAVTVPDYPSEGEQPVITVDDPNQLPDGNTPGTTEVDVTVTYPDGTTDHIKVPVTVGEEVQANTNDPGYDNVTVDPGETVKVPQTGDNTMPDGTQYEIDKSKVPSGWEVTVDHNTGELTVKPSENAVPGTSIVIPVTVTYPDGSTEEVSTTITVGDVIDIPAPTVNPVDDNDTEVTGTDGTPGNTIVVTFPDGSTSEGNIDEDGNWTVDIPEGVDLDKGDVITVVEKDKDGKVSTPTKVVVGENCDNPSNGDNSGDGAGNDSSDGDNSGDGADKGSSNADNSKDEEGNNSSDSNNSVEGNKGLTDNNATTDSNNTASVNNTDQTDSNNDVSELNEDNNTSNNTHKQNNSEAKALPETGETDGKQATIFGALFAGLGSLLLFRRRNKNEEK

SEQ ID NO: 30351 - protein, 312 aa, Staphylococcus aureus
MVKKRILAATLSLGIITPIAISFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30352 - protein, 325 aa, Staphylococcus aureus
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETLNYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKNPMS

SEQ ID NO: 30353 - protein, 212 aa, Staphylococcus aureus
MYKRLFISRVILIFALILVISTPNVLAESQPDPMPDDLHKSSEFTGTMGNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLVRVYENKRNTISFEVQTDKKSVTAQELDIKARNFLINKKICMSLTVHHMKQDI

SEQ ID NO: 30354 - protein, 233 aa, Staphylococcus aureus
SEKSEEINEKDLRKKSELQGTALGNLKQIYYYNEKAKTENKESHDQFLQHTILFKGFFTDHSWYNDLLVDFDSKDIVDKYKGEKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQYSNTLLRIYRDNKTINSENMHIDIYLYTS

SEQ ID NO: 30355 - protein, 454 aa, Staphylococcus aureus
  MOD_RES (169)..(169): Any amino acid
  MOD_RES (183)..(184): Any amino acid
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNXFNKEQQNAFYEILXXPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30356 - protein, 1490 aa, Staphylococcus aureus
MFLLKKKLDFLPNKLNKYSIRRFTVGTASILVGSTLLFGIGNEAHAAEEHQKSNTTENVADSNASEAPTKEEAPSNEATSEAPTKEEVPSNEATSEAPTKEEAPSNEATSEAPTKEEAPSNEATSEAPTKEEAPSNEATSEASTKEEAPAAEETDKATEEAPKTEETDKATKEEAPAVEETSKAATEEAPKAEETDKATEEAPKTEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGKLTAFNTNFNPDTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFAPEEVPQGHKDEFDPNLPIDGTEEVPGKPGIKNPETGKVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGKVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGKVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDSDADSDSDADSDSDADSDSDADSDSDADSDSDADSDSDADSDSDADSDSDADSDSDADSDSDADSDSDADSDSDADSDSDADSDSDSDSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDSDSDSDADSDSDADSDSDADSDSDSDSDSDADSDSDADSDSDADRDHNDKTDKPNNKELPDTGNDAQNNGTLFGSLFAALGGLFLVGRRRKNKNNEEK

SEQ ID NO: 30357 - protein, 241 aa, Staphylococcus aureus
MNEGELKMNKKLLMNFFIVSPLLLATIATDFTPVPLLSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30358 - protein, 240 aa, Staphylococcus aureus
MKKRLLFVIVITLFIFSSNHTVLSNGDVGPGNLRNFYTKYEYVNLKNVKDKNSPESHRLEYSYKNDTLYAEFDNEYITSDLKGKNVDIFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEISKR

SEQ ID NO: 30359 - protein, 691 aa, Staphylococcus aureus
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNVTNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGTAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 30360 - protein, 88 aa, Staphylococcus aureus
PLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 30361 - protein, 244 aa, Staphylococcus aureus
MKMNKIFRVLTVSLFFFTFLIKNNLAYADVGVINLRNFYTNYQPETLQGVSSGNFSTSHQLEYIDGKYTLYSQFHNEYEAKRLKDHKVDIFGISYSGLCNTKYMYGGITLANQNLDKPRNIPINLWVNGKQNTISTDEVSTQKKEVTAQEIDIKLRKYLQNEYNIYGFNKTKKGQEYGYQSKFNSGFNKGKITFHLNNETSFTYDLFYTGTGQAESFLKIYNDNKTIDAENFHLDVEISYEKTE

SEQ ID NO: 30362 - protein, 266 aa, Staphylococcus aureus
MYKRLFISHVILIFVLILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIESENSFWYDMMPAPGDKFDQSKYLMMYNDNKLVDSKDVKIEVYLTTKKK

SEQ ID NO: 30363 - protein, 266 aa, Staphylococcus aureus
MYNRLFVSRVILIFALILVIYTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNHLDKYRSITVRVFEDGKNLLSFDVQTNKKKVTAQELDYLTRHYLVKNKKLYEFNNSPYETGYIKFIESENSFWYDMMPAPGDKFDQSKYLMMYNDNKLVDSKDVKIEVYLTTKKK

SEQ ID NO: 30364 - protein, 242 aa, Staphylococcus aureus
MKKLIVIILINIITLSVSNSASAQGDIGIDNLRNFYTKKDFVDLKDVKDNDTPIANQLQFSNESYDLISESKDFNKFSNFKGKKLDVFGISYNGQCNNKYIYGGVTATNEYLDKPRNIPINIWINGNHKTISTNKVSTNKKFVTAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 30365 - protein, 266 aa, Staphylococcus aureus
MYNRLFVSRVILIFALILVIYTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNHLDKYRSITVRIFEDGKNLLSFDVQTNKKKVTAQELDYLTRHYLVKNKKLYEFNNSPYETGYIKFIESENSFWYDMMPAPGDKFDQSKYLMMYNDNKLVESKDVKIEVYLTTKKK

SEQ ID NO: 30366 - protein, 559 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLASGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30367 - protein, 559 aa, Staphylococcus aureus
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNASDLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30368 - protein, 556 aa, Staphylococcus aureus
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPE

SEQ ID NO: 30369 - protein, 559 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNSNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30370 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDKPGEIEPIPE

SEQ ID NO: 30371 - protein, 559 aa, Staphylococcus aureus
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVINQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30372 - protein, 558 aa, Staphylococcus aureus
MNMKKKEKHAIRKKSIGVASVLVGTLIGFGLLSSKEADASENSVTQSDSASNESKSNDSSSVNAAPKTDNANLSDTKTTSNSNNGETSVAQNPAQQETTQSASTNATTEETPATGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDKVLANGVIDSDGNVIYTFTDYVDTKENVTANITMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30373 - protein, 559 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVYNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 30374 - protein, 558 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPSIMAGDQVLANGVIDSDGNVIYTFTDYVDTKNDVKATLTVPAYIDPENVTKTGNVTLKTGIGTNTDSKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPE

SEQ ID NO: 30375 - protein, 559 aa, Staphylococcus aureus
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDDPGEIEPIPE

SEQ ID NO: 30376 - protein, 160 aa, Staphylococcus aureus
IGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFHSAPSIGGSGSFNYSKTISYNQKNYVTEVESQNSKGVKWGVKANSFVTP

SEQ ID NO: 30377 - protein, 160 aa, Staphylococcus aureus
IGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTP

SEQ ID NO: 30378 - protein, 160 aa, Staphylococcus aureus
IGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSEGVKWGVKANSFVTP

SEQ ID NO: 30379 - protein, 160 aa, Staphylococcus aureus
IGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTAVESQNSKGVKWGVKANSFVTP

SEQ ID NO: 30380 - protein, 230 aa, Staphylococcus aureus
MKLKNIAKASLALGILTTGMITTTAQPVKADETSSRLAVTSKDTQELKKYYSGTGYNFQNVSGYSENDKMNVFFGPQLNVISLLGSDKERFKDGDYNGLDVFVVREGSGRQADNNSIGGITKTNKNGYTDFVKNVGLEITKPTGHNTATRQAETYSINKEEISLKELDFKLRKHLIDNNGLYNTEPKDSKIKVTMQNGDFYTFELNKKLQTHRMGDVIDGRNIEKIEVNL

SEQ ID NO: 30381 - protein, 330 aa, Staphylococcus aureus
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30382 - protein, 398 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKNLVKKTATSLVKKTTKNLVKKTATEYMSLNLVIQ

SEQ ID NO: 30383 - protein, 309 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKTW

SEQ ID NO: 30384 - protein, 419 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKKTTTSLAKKTATSLVKKTTKNLVKKMATSLVKKTTKNLVKKTATSLAKKMATNLVKKMVTEYMSFKDDLR

SEQ ID NO: 30385 - protein, 286 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLTEEQRNGFIQSLKDDPSVSKEILAEAKKLNDAQAPKEEDNKKPGKEDGNKKTW

SEQ ID NO: 30386 - protein, 367 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNKKTW

SEQ ID NO: 30387 - protein, 399 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNKKPGKEDNNKPGKEDGNKPGKEDNKKTWQRRQQQAW

SEQ ID NO: 30388 - protein, 391 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKTW

SEQ ID NO: 30389 - protein, 657 aa, Staphylococcus aureus
AAKPLDKSSSTLHHGHSNTQIPYTITVNGTSQNILSSLTFNKNQNISYKDIENKVKSVLYFNRGISDIDLRLSKQAEYTVHFKNGTKRVIDLKSGTYTADLINTSDIKAISVNVDTKKQPKDKAKANVQVPYTITVNGTSQNILSNLTFNKNQNISYKDLEDRVKSVLESNRGITDVDLRLSKQAKYTVNFKNGTKKVIDLKAGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHVKDVKRIEITVKTGTKAKADRYVPYTIAVNGTSTPILSDLKFTGDPRVGYKDITKKVKSVLKHDRGIGERELKYAKKATYTVHFKNGKKKVINLNSKISQLNLLYVQDIKKIDIDVKTGSKAKADSYVPYTIAVNGTSTPILSKLKISNKQLISYKYLNDKVKSVLKNERGISDLDLKFAKQAKYTVYFKNGKKQVVNLKSDIFTPNLFSAKDIKKIDIDVKTGSKAKADSYVPYTIAVNGTSTPILSKLKISNKQLISYKYLNDKVKSVLKSERGISDLHLKFAKQAKYTVYFKNGKKQVVNLKSDIFTPNLFSAKDIKKIDIDVKQYTKSKKNK

SEQ ID NO: 30390 - protein, 291 aa, Staphylococcus aureus
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 30391 - protein, 312 aa, Staphylococcus aureus
MVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30392 - protein, 325 aa, Staphylococcus aureus
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWINFNWIGNNYKDENRATHTSIYEVDWENHTVKLIDTQSKEKNPMS

SEQ ID NO: 30393 - protein, 314 aa, Staphylococcus aureus
MFKKKMLAASLSVGLIAPLASPIQESRANTNIENIGDGAEVIKRTEDVSSKKWGVTQNVQFDFVKDKKYNKDALIVKMQGFINSRTSFSDVKGRGYELTKRLIWPFQYNIGLTTKDPNVSLINSITLPKTKIETTDVGQTLGYNIGGNFQSAPSIGGNGSFNYSKTISYTQKSYVSEVDKQNSKSVKWGVKANKFVTPDGKKFAHDRYLFVQSPNGPTGSAREYFAPDNQLPPLVQSGFNPSFITTLSHEKGSKLIRVNLKFSYGRNLDITYATLFPRTGIYAERKHNAFVNRNFVVRYKVNWKTHEIKVKGHN

SEQ ID NO: 30394 - protein, 327 aa, Staphylococcus aureus
MKIEKLGKSSVASSIALLLLSNTVDAAQNITPKREKKVDDKITLYKTTATSDNDKLNIFQILTFNFIKDKSYDKDTLVLKAAGNINSGYKNSNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGDKSSSNAGQNFLPTHQIPLLARGNFNPEFISVLSHKLFDTKKSKIKVTYQREMDRYTNQWNRSHWVGNNYKNQNTVTFTSTYEVDWQNILLKLIGTDSKETNPGV

SEQ ID NO: 30395 - protein, 234 aa, Staphylococcus aureus
MNKKLLMNFFIVSPLLLATIATDFTPVPLSSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30396 - protein, 242 aa, Staphylococcus aureus
MKKLISILLINIIILGVSNNASAQGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKLVTAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 30397 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 30398 - protein, 268 aa, Staphylococcus aureus
MKKTIFILIFSLTLTLLITPLVYSDSKNETIKEKNLHKKSELSSITLNNLRHIYFFNEKGISEKIMTEDQFLDYTLLFKSFFISHSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFDGKIQKGLIVFHTSKEPLVSYDLFNVIGQYPDKLLKIYQDNKIIESENMHIDIYLYTSLIVLISLPLVL

SEQ ID NO: 30399 - protein, 242 aa, Staphylococcus aureus
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 30400 - protein, 231 aa, Staphylococcus aureus
MLVMTEYLLSAGICMAIVSILLIGMAISNVSKGQYAKRFFFFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQHLRKSEAQAKKEKLNIWSEDNADSGQ

SEQ ID NO: 30401 - protein, 266 aa, Staphylococcus aureus
MYKRLFISHVILIFALILVISTPNVLAESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30402 - protein, 266 aa, Staphylococcus aureus
MNKSRFISCVILIFALILVLFTPNVLAESQPDPTPDELHKASKFTGLMENMKVLYDDHYVSATKVKSVDKFLAHDLIYNISDKKLKNYDKVKTELLNEGLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30403 - protein, 234 aa, Staphylococcus aureus
MNKKLLMNFFIVSPLLLATTATDFTPVPLSSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYGPKFDKKQLAISTLDFEIRHQLTQIHGLYRSSDKTGGYWKITMNDGSTYQSDLSKKFEYNTEKPPINIDEIKTIEAEIN

SEQ ID NO: 30404 - protein, 319 aa, Staphylococcus aureus
MKTRIVSSVTTTLLLGSILMNPVAGAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 30405 - protein, 330 aa, Staphylococcus aureus; identical to SEQ ID NO: 30381

SEQ ID NO: 30406 - protein, 309 aa, Staphylococcus aureus
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 30407 - protein, 325 aa, Staphylococcus aureus
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 30408 - protein, 257 aa, Staphylococcus aureus; identical to SEQ ID NO: 30259

SEQ ID NO: 30409 - protein, 266 aa, Staphylococcus aureus
MYKRLFISRVILIFALILVISTPNVLAESQPDPMPDDLHKSSEFTGTMGNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLVRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30410 - protein, 258 aa, Staphylococcus aureus
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30411 - protein, 241 aa, Staphylococcus aureus
MINKIKILFSFLALLLSFTSYAKAEDLHDKSELTDLALANAYGQYNHPFIKENIKSDEISGEKDLIFRNQGDSGNDLRVKFATADLAQKFKNKNVDIYGASFYYKCEKISENISECLYGGTTLNSEKLAQERVIGANVWVDGIQKETELIRTNKKNVTLQELDIKIRKILSDKYKIYYKDSEISKGLIEFDMKTPRDYSFDIYDLKGENDYEIDKIYEDNKTLKSDDISHIDVNLYTKKKV

SEQ ID NO: 30412 - protein, 354 aa, Staphylococcus aureus
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKNENRQTTKVVSSEATKDQSQTQSARTVKTTQTAQDQNKVQTPVKDVATAKSESNNQAVSDNKSQQTNKVTKQNEVHKQGPSKDSKAKELPKTGLTSVDNFISTVAFATLALLGSLSLLLFKRKESK

SEQ ID NO: 30413 - protein, 393 aa, Staphylococcus aureus
MNSSCKTRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLANNIKEKESAKTVSPQLKQELKTTVTPTKVEENEAIQEDQVQYENTLKNFKIREQQFDNSWCAGFSMAALLNATKNTDTYNAHDIMRTLYPEVSEQDLPNCATFPNQMIEYGKSQGRDIHYQEGVPSYNQVDQLTKDNVGIMILAQSVSQNPNDPHLGHALAVVGNAKINDQEKLIYWNPWDTELSIQDADSSLLHLSFNRDYNWYGSMIGY

SEQ ID NO: 30414 - protein, 334 aa, Staphylococcus aureus
MQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNAASNSSRPSTNSGGGSYYTVQAGDSLSLIASKYGTTYQKIMSLNGLNNFFIYPGQKLKVTGNASTNSGSATTTNRGYNTPVFSHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 30415 - protein, 336 aa, Staphylococcus aureus
MKGKFLKVSSLFVATLTTATLVSSPAANALSSKAMDNHPQQTQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDEPNNPDNPNNPDNPDNGDNNNSDNPDAA

SEQ ID NO: 30416 - protein, 26 aa, Staphylococcus aureus
MAQDIISTIGDLVKWIIDTVNKFTKK

SEQ ID NO: 30417 - protein, 1255 aa, Staphylococcus aureus
MLGVINRMAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSEHQINPELIKSAAKPAALETQYKAAAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQFTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKSGTKLYTVPWGTSKQVAGSVSGSGNQTFKASKQQQIDKSIYLYGSVNGKSGWVSKAYLVDTAKPTPTPIPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 30418 - protein, 165 aa, Staphylococcus aureus
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVR

SEQ ID NO: 30419 - protein, 690 aa, Staphylococcus aureus
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 30420 - protein, 257 aa, Staphylococcus aureus
MKKTAFILLLFIALTLTTSPLVNGSEKSEEINEKDLRKKSELQRNALSNLRQIYYYNEKAITENKESDDQFLENTLLFKGFFTGHPWYNDLLVDLGSKDATNKYKGKKVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNKTINSENLHIDLYLYTT

SEQ ID NO: 30421 - protein, 258 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYPIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 30422 - protein, 247 aa, Staphylococcus aureus; identical to SEQ ID NO: 30155

SEQ ID NO: 30423 - protein, 481 aa, Staphylococcus aureus
MQAKLTKNEFIERLKTSEGKQFNVDLWYGFQCFDYANAGWKVLFGLLLKGLGAKDIPFANNFDGLATVYQNTPDFLAQPGDMVVFGSNYGAGYGHVAWVIEATLDYIIVYEQNWLGGGWTDGIEQPAGVGKKLQDDNMLMISLCGLSVRILKVRQRHDQFNLLHKHPKKETAKPQPKAVELKIIKDVVKGYDLPKRGSNPKGIVIHNDAGSKGATAEAYRNGLVNAPLSRLEAGIAHSYVSGNTVWQALDESQVGWHTANQIGNKYYYGIEVCQSMGADNATFLKNEQATFQECARLLKKWGLPANRNTIRLHNEFTSTSCPHRSSVLHTGFDPVTRGLLPEDKRLQLKDYFIKQIRAYMDGKIPVATVSNESSASSNTVKPVASAWKRNKYGTYYMEESARFTNGNQPITVRKVGPFLSCPVGYQFQPGGYCDYTEVMLQDGHVWVGYTWEGQRYYLPIRTWNGSAPPNQILGDLWGEIS

SEQ ID NO: 30424 - protein, 323 aa, Staphylococcus aureus
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNAVDYAPKNQNEEFQVQNTLGYTFGGDISISNGLSGGLNGNTAFSETINYKQESYRTLSRNTNYKNVGWGVEAHKIMNGWGPYGRDSFHPTYGNELFLAGRQSSAYAGQNFIAQHQMPLLSRSNFNPEFLSVLSHRQDRAKKSKITVTYQREMDLYQIRWNGFYWAGANYKNFKTRTFKSTYEIDWENHKVKLLDTKETENNK

SEQ ID NO: 30425 - protein, 315 aa, Staphylococcus aureus
MLKNKILATTLSVSLLAPLANPLLENAKAANDTEDIGKGSDIEIIKRTEDKTSNKWGVTQNIQFDFVKDTKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 30426 - protein, 266 aa, Staphylococcus aureus
MNKSRFISCVILIFALILVLFTPNVLAESQPDPTPDELHKSSEFTGTMGNMKYLYDDHYVSATKVMSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30427 - protein, 508 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30428 - protein, 233 aa, Staphylococcus aureus
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 30429 - protein, 163 aa, Staphylococcus aureus
MLKRSLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVVIEKK

SEQ ID NO: 30430 - protein, 1637 aa, Staphylococcus aureus
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKANTTEQASTEEKADTTEQATTEEAPKAEGTDKVETEEAPKAEETDKATTEEAPKAEETDKATEEAPKTEETDKATTEEAPAAEETSKAATEEAPKAEETSKAATEEAPKAEETEKTATEEAPKTEETDKVETEEAPKAEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGTLTAFNTNFNPNTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFTPEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDADSDSDADSDSDADSDSDADSDSDADSDSDSDSDSDSDSDSDADSDSDSDSDSDADSDSDADSDSDADSDSDSDADSDSDSDADSDSDSDSDSDADSDSDSDSDSDADSDSDADSDSDSDSDSDADSDSDSDSDSDADSDSDADSDSDADSDSDADSDSDSDSDSDADSDSDADSDSDADSDSDADSDSDSDSDSDADSDSDSDSDSDSDADSDSDADSDSDSDADSDSDADSDSDADGDSDADSDSDADSDSDSDSDSDSDSDSDADSDSDSDSDSDADRDHNDKTDKPNNKELPDTGNDAQNNGTLFGSLFAALGGLFLVGRRRKNKNNEEK

SEQ ID NO: 30431 - protein, 388 aa, Staphylococcus aureus
MKRNFPKLIALSLIFSLSITPIANAESNSNIKAKDKRHVQVNVEDKSVPTDVRNLAQKDYLSYVTSLDKIYNKEKASYTLGEPFKIYKFNKKSDGNYYFPVLNTEGNIDYIVTISPKVTKDSSSSSKYTINVSSFLSKALNEYKDQQITILTNSKGYYVVTQNHKAKLVLKTPRLEDKKAKKTESIPTGNNVTQLKQKASVTMPTSQFKSNNYTYNEQYVNKLENFKIRETQGNNGWCAGYTMSALLNATYNTNKYHAEAVMRFLHPNLQGQQFQFTGLTPREMIYFEQTQGRSPQLLNRMTTYNEVDNLTKNNKGIAILGSRVESRNGMHAGHAMAVVGNAKLNNGQEVIIIWNPWDNGFMTQDAKNNVIPVSNGDHYQWYSSIYGY

SEQ ID NO: 30432 - protein, 146 aa, Staphylococcus aureus
VYSDSKNETIKEKNLHKKSELSTITLNNLRHIYFSNEKGISEKIMTEDQFLDYTLLFKSFFISHSQYNDLLVQFDSKETVNKFKGKQVDLYGSYYGFQCSGGKPNKTACMYGGVTQHENNQLYDTKKIPINLWIDSIRTVVPLEEG

SEQ ID NO: 30433 - protein, 153 aa, Staphylococcus aureus
FGDIGVGNLRNFYTKHDYIDLKGVTDKNLPIANQLEFSTGTNDLISESNNWDEISKFKGKKLDIFGIDYNGPCKSKYMFGGATLSGQYLNSARKIPINLWVNGKHKTISTDKIATNKKLVTAQEIDVKLRRYLQEEYNIYGHNNTGKGKEYGY

SEQ ID NO: 30434 - protein, 239 aa, Staphylococcus aureus
ESQPDPMPDDLHKSSEFTGTMGNMKYLYDDHYVSATKVKSVDKFLAHDLIYNISDKRLKNYDKVKTELLNEDLAKKYKDEVVDVYGSNYYVNCYFSSKDNVGKVTGGKTCMYGGITKHEGNHFDNGNLQNVLVRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30435 - protein, 239 aa, Staphylococcus aureus
ESQPDPMPDDLHKSSEFTGTMDNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLVRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30436 - protein, 239 aa, Staphylococcus aureus
ESQPDPTPDELHKSSEFTGTMGNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKRVKIEVHLTTKNG

SEQ ID NO: 30437 - protein, 239 aa, Staphylococcus aureus
ESQPDPTPDELHKASKFTGLMENMKVLYDDRYVSATKVKSVDKFLAHDLIYNISDKKLKNYDKVKTELLNEDLAKKYKDEVVDVYGSNYYVNCCFSSKDNVGKVTGGKTCMYGGITKHEGNHFDNGNLQNVLIRVYENKRNTISFEVQTDKKSVTAQELDIKARSFLINKKNLYEFNSSPYETGYIKFIENNGNTFWYDMMPAPGDKFDQSKYLMMYNDNKTVDSKSVKIEVHLTTKNG

SEQ ID NO: 30438 - protein, 239 aa, Staphylococcus aureus
ESQPDPMPDDLHKSSEFTGTMGNMKYLYDDHYVSATKVKSVDKFLAHDLIYNINHKKLNNYDKVKTELLNEDLAKNYKDEVVDVYGSNYYVNCYFSSKDNVGKVTSGKTCMYGGITKHEGNHFDNGNLQNVLIRVYENKRNTISFEVQTDKKSVTAQELDIKARNFLINKKNLYEFNSSPYETGYIKFIESNGNTFWYDMMPAPGDKFDQSKYLMIYKDNKMVDSKSVKIEVHLTTKNG

SEQ ID NO: 30439 - protein, 135 aa, Staphylococcus aureus
TSPPVEGRGVINSRQFLSHDLIFPIEYKSYNEVKTELENTELANNYKDKKVDIFGVPYFYTCIIPKSEPDINQNFGGCCMYGALTFNSSENERDKLITVQVTIDNRQSLGFTITTNKNMVTIQELDYKARHWLTK

SEQ ID NO: 30440 - protein, 315 aa, Staphylococcus aureus
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 30441 - protein, 242 aa, Staphylococcus aureus
MKKIKYSFILVFILFFNIKDLSYAQGDIGVGNLRNFYTKYDYIDLKGVTDKNLPIANQLEFSTGTNDLISESNNWDEISKFKGKKLDIFGIDYNGPCKSKYMYGGVTLSGQYLNSARKIPINLWVNGKHKTISTDKIATNKKLVTAQEIDVKLRRYLQEEYNIYGHNNTGKGKEYGYKSKFYSGFNKGKVLFHLNDEKSFSYDLFYTGDGLPVSSLKIYEDNKILQSEKFHLDVEISNVDSN

SEQ ID NO: 30442 - protein, 258 aa, Staphylococcus aureus
MKKLSTVIIILILEIVFHNINYANALPDPKIDELNKVSDYKSNKGTMGNVMNLYMSPPVEGRGVINSRQFLSHDLIFPIEYKSYNEVKTELENIELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30443 - protein, 1149 aa, Staphylococcus aureus
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDAINPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 30444 - protein, 207 aa, Staphylococcus aureus
KHSYADKNPIIGENKSTGDQFLENTLLYKKFFTDLINFEDLLINFNSKEMAQHFKSKNVDVYPIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 30445 - protein, 239 aa, Staphylococcus aureus
ESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNHLDKYRSITVRVFEDGKNLLSFDVQTNKKKVTAQELDYLTRHYLVKNKKLYEFNNSPYETGYIKFIESENSFWYDMMPAPGDKFDQSKYLMMYNDNKMVDSKDVKIEVYLTTKKK

SEQ ID NO: 30446 - protein, 993 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 30447 - protein, 969 aa, Staphylococcus aureus
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSASDSDSASDSDSASDSDSTSDSDSTSDSDSASDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 30448 - protein, 307 aa, Staphylococcus aureus
TITVNGTSQNILSSLTFNKNQQISYKDLENKVKSVLYFNRGISDIDLRLSKQAEYTVHFKNGTKKVVDLKSGIYTADLINTSDIKAISVNVDTKKQPKDKAKANVQVPYTITVNGTSQNILSSLTFNKNQNVSYKDLEDKVKSVLESNRGITDVDLRLSKQAKFTVNFKNGTKKVIDLKAGIYTANLINSSDIKSININVDTKKHIENKAKRNYQVPYSINLNGTSTNILSNLSFSNKPWTNYKNLTSQVKSVLKHDRGISEQDLKYAKKAYYTVYFKNGGKRVVHFNSKTYSANLVHAKDVKKIEV

SEQ ID NO: 30449 - protein, 307 aa, Staphylococcus aureus; identical to SEQ ID NO: 30448

SEQ ID NO: 30450 - protein, 307 aa, Staphylococcus aureus; identical to SEQ ID NO: 30448

SEQ ID NO: 30451 - protein, 44 aa, Staphylococcus aureus
MSCLILRIFILIKEGVISMAQDIISTISDLVKWIIDTVNKFTKK

SEQ ID NO: 30452 - protein, 254 aa, Staphylococcus aureus
IFVLILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30453 - protein, 241 aa, Staphylococcus aureus; identical to SEQ ID NO: 30411

SEQ ID NO: 30454 - protein, 322 aa, Staphylococcus aureus
MKIKNIVKSSVATSITFIMLSNTVDAAQHITPVSEKKVDDKITLYKTTATSDSDKLKISQILTFNFIKDKSYDKDTLILKAAGNIYSGYTQPTSDSSINSQFYWGAKYNVFVSSESKDSVNIVDYAPKNQNEEFQVQQTLGYSYGGDINIINGLTGGLNGSKSFSETINYKQESYRTTIDRKINHKLIGWGVEAHKIMNNGWGPYGRDSSDSLYGNELFLGGRQSSSNANQNFLPTHQMPILARGNFNPEFISVLSHKQKDVKKSKIKVTYQRQMDRYENFWNNLHWIGYNIKNQKRATHTSIYEIDWEKHTVKLVASQSSE

SEQ ID NO: 30455 - protein, 308 aa, Staphylococcus aureus
MFKRKLLVTTLSLGLIVPIATPFQGSKATTNAEDIGDDAEVIKRTEDVSSRKWGVTQNVQFDFVKDKKYNKDALIIKMQGFINSRTTFNDVKQNRANKRMVWPFQYNIGLTSKDQNTSLINYLPKNKIETVDVGQTLGYNIGGKFQSAPSIGGNGSFNYSKSIKYSQKSYVSEVEQQSSKTIKWGVKANSFVIAGHRWSAYDELLFIRNTTRGPNARDYFVDDNELPPLITSGFNPSFIATVSHEKDSGDTSEFEITYGRNMDVTYATYLPKQGLYPERKHNEFVNRNFVVKYEVNWKTHEIKVKGHN

SEQ ID NO: 30456 - protein, 110 aa, Staphylococcus aureus
PNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30457 - protein, 218 aa, Staphylococcus aureus
QGDIGVGNLRNFYTKHDYIDLKGLIDKNLPSANQLEFSTGINDLISESNNWDEISKFKGKKLDIFGIDYNGPCKSKYMYGGATLSGQYLNSARKIPINLWVNGKHKTISTDKISTNKKLVTAQEIDVKLRRYLQEEYNIYGHNSTGKGKEYGYKSKFYSGFNKGKVLFHLNDEKSFSYDLFYTGDGVPVSFLKIYEDNKIIESEKFHLDVEISYVDSN

SEQ ID NO: 30458 - protein, 210 aa, Staphylococcus aureus
LKKFLYKHDSIDSKGLIDKNLPSANQLEFSTGINDLISESNNWDEISKFKGKKLDIFGIDYNGPCKSKYMYGGATLSGQYLNSARKIPINLWVNGKHKTISTDKISTNKKLVTAQEIDVKLRRYLQEEYNIYGHNSTGKGKEYGYKSKFYSGFNKGKVLFHLNDEKSFSYDLFYTGDGVPVSFLKIYEDNKIIESEKFHLDVEISYVDSN

SEQ ID NO: 30459 - protein, 209 aa, Staphylococcus aureus
LRISIKYDYIDLKGVTDKNLPIANQLEFSTGTNDLISESNNWDEISKFKGKKMDIFGIDYNGPCKTKYMYGGATLSGQYLNSARKIPINLWINGKHKTISTDKIATNKKLVTAQEIDVKLRRYLQEEYNIYGHNNNGKGKEYGYKSKFYSGFNKGKVLFHLNDEKSFSYDLFYTGDGLPVSFLKIYEDNKIIESEKFHLDVEISYVDSN

SEQ ID NO: 30460 - protein, 223 aa, Staphylococcus aureus
LTISSDYKSNKGTMGNVMNLYMSPPVEGRGVINSRQFLSHDFIFPIEYKSYNEVKTELENTELANNYKGKKVDIFGVPYFYTCIIPKSEPDINQNFGGCCMYGGLTFNSSENEGDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLN

SEQ ID NO: 30461 - protein, 689 aa, Staphylococcus aureus
MKFKSLITTTLALGVIASTGANLDTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGGIKNININVETKKQAKDKEAKVNNQVPYSINLNGTTTNIQSNLAFSNKPWTNYKNLTTKVKSVLKSDRGVSERDLKHAKKAYYTVYFKNGGKRVIHLNSNIYTANLVHAKDVKRIEVTVKTVSKVKAERYVPYTIAVNGASNPTLSDLKFTGDSRVSYSDIKKKVKSVLKHDRGIGERELKYAEKATYTVHFKNGTKKVINLNSNISQLNLLYVKDIKNIDIDVKTGAKAKVYSYVPYTIAVNGTTTPIASKLKLSNKQLIGYQDLNKKVKSVLKHDRGINDIELKFAKQAKYTIHFKNGKTQVVDLKSDIFTRNLFSVKDIKKIDINVKQQSKSNKALNKVTNKATKVKFPVTINGFSNLVSNEFAFLHPHKITTNDLNAKLRLALRSDQGITKHDIGLSERTVYKVYFKDGSSKLEDLKAAKQDSKVFKATDIKKVDIEIKF

SEQ ID NO: 30462 - protein, 1183 aa, Staphylococcus aureus
MNKNVLKFMVFIMLLNIITPLFNKNEAFAARDISSTNVTDLTVSPSKIEDGGKTTVKMTFDDKNGKIQNGDMIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSNYYSGQSAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPRPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKAIKYLVKEVNAQGEDTTPEGYTKKENGLVVTNTEKPIETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTAILNESNNWTHTWTGLDEKAKGQQVKYTVEELTKVKGYTTHVDNNDMGNLIVTNKYTPETTSISGEKVWDDKDNQDGKRPEKVSVNLLADGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTAILNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTAILNESNNWTHTWTGLDEKAKGQQVKYTVDELTKVNGYTTHVDNNDMGNLIVTNKYTPKKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 30463 - protein, 239 aa, Staphylococcus aureus
ESQPDPTPDELHKASKFTGLMENMKVLYDDRYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGKLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30464 - protein, 44 aa, Staphylococcus aureus
MKNNLRYGIRKHKLGAASVFLGTMIVVGMGQTKKLQHQTKRQLQ

SEQ ID NO: 30465 - protein, 940 aa, Staphylococcus aureus
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 30466 - protein, 315 aa, Staphylococcus aureus
MLKNKILATTLSVSLLAPLANPLLENAKAANDTEDIGKGNDVEIIKRTEDKTSNKWGVTQNIQFGFVKDKKYNKVALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 30467 - protein, 315 aa, Staphylococcus aureus
MLKNKILATTLSVSLLAPLANPLLENAKAANDTEDIGKGNDVEIIKRTEDKTSNKWGVTQNIQFDFVKDKKYNKDALILKMQGFISSRTTYYNSKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 30468 - protein, 308 aa, Staphylococcus aureus
MFKRKLLVTTLSLGLIVPIATPFQGSKATTNAEDIGDDAEVIKRTEDVSSRKWGVTQNVQFDFVKDKKYNKDALIIKMQGFINSRTTFNDVKQNRANKRMVWPFQYNIGLTSKDQNTSLINYLPKNKIETVDVGQTLGYNIGGKFQSVPSIGGNGSFNYSKSIKYSQKSYVSEVEQQSSKTIKWGVKANSFVIAGHRWSAYDELLFIRNTTRGPNARDYFVDDNELPPLITSGFNPSFIATVSHEKDSGDTSEFEITYGRNMDVTYATYLPKLGLYPERKHNEFVNRNFVVKYEVNWKTYEIKVKGHN

SEQ ID NO: 30469 - protein, 322 aa, Staphylococcus aureus
MKFKNIVKSSVATSITLIMLSNTVDAAQHITPVSEKKVDDKITLYKTTATSDSDKLKISQILTFNFIKDKSYDKDTLILKAAGNIYSGYTQPTSDSSINSQFYWGAKYNVFVSSESKDSVNIVDYAPKNQNEEFQVQQTLGYSYGGDINIINGLTGGLNGSKSFSETINYKQESYRTTIDRKTNHKSIGWGVEAHKIMNNGWGPYGRDSSDSLYGNELFLGGRQSSSNANQNFLPTHQMPILARGNFNPEFISVLSHKQKDVKKSKIKVTYQREMDRYENFWNNLHWIGYNIKNQKRATHTSIYEIDWEKHTVKLVASQSSE

SEQ ID NO: 30470 - protein, 308 aa, Staphylococcus aureus
MFNRKLLVTTLSLGLIVPIATPFQGSKATTNAEDIGDDAEVIKRTEDVSSRKWGVTQNVQFDFVKDKKYNKDALIIKMQGFINSRTTFNDVKQNRANKRMVWPFQYNIGLTSKDQNTSLINYLPKNKIETVDVGQTLGYNIGGKFQSVPSIGGNGSFNYSKSIKYSQKSYVSEVEQQSSKTIKWGVKANSFVIAGHRWSAYDELLFIRNTTRGPNARDYFVDDNELPPLITSGFNPSFIATVSHEKDSGDTSEFEITYGRNMDVTYATYLPKLGLYPERKHNEFVNRNLVVKYEVNWKTSELKVRGHN

SEQ ID NO: 30471 - protein, 312 aa, Staphylococcus aureus
MVKKRLLAATLSLGIITPIATSFHESKADNNIENIGDCAEVVKRTEDTSCDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHKAFVNRNYTVKYEVNWKTHEIKVKGHN

SEQ ID NO: 30472 - protein, 325 aa, Staphylococcus aureus
MKKIVKSREVTSIALLLLSNTLDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQSEMDRYTNFWINFNWIGNNYKDHIRATHTSIYEVDWENHTVKLIDTQSKEKNPMS

SEQ ID NO: 30473 - protein, 454 aa, Staphylococcus aureus
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAVDNKLADKNMIKPGQELVVDKKQPANHADANKAQALPETGEENPFIGTTVFGGLSLALGAALLAGRRREL

SEQ ID NO: 30474 - protein, 472 aa, Staphylococcus aureus
MKKKKIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRPSPNYKNKQYTTIDIILSKPILTYIR

SEQ ID NO: 30475 - protein, 240 aa, Staphylococcus aureus
MNKNVVIKSLATLTILTSVTGIGTTLVEEVQQTAKAENNVTKIQDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 30476 - protein, 239 aa, Staphylococcus aureus
MNKNIVIKSMAALAILTSVTGINAAVVEETQQIANAEKNVTQVKDTNNFPYNGVVSFKDATGFVIGKNTIITNKHVSKDYKVGDRITAHPNGDKGNGGIYKIKSISDYPGDEDISVMNIEEQAVERGPKGFNFNENVQAFNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 30477 - protein, 266 aa, Staphylococcus aureus; identical to SEQ ID NO: 30426

SEQ ID NO: 30478 - protein, 266 aa, Staphylococcus aureus; identical to SEQ ID NO: 30409

SEQ ID NO: 30479 - protein, 325 aa, Staphylococcus aureus
MNMNKLVKSSVATSMALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 30480 - protein, 682 aa, Staphylococcus aureus
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKASLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 30481 - protein, 242 aa, Staphylococcus aureus
MKKFKYSFILVFILLFNIKELTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 30482 - protein, 258 aa, Staphylococcus aureus
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDCSAFESGYIKFTEKNNTSFWFDLFPKKELVPFVPYKFLNIYGDNKVVDSKSIKMEVFLNTH

SEQ ID NO: 30483 - protein, 258 aa, Staphylococcus aureus
MKKLSTVIIILILEIVFHNINYANSQPDPKIDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFRNTH

SEQ ID NO: 30484 - protein, 325 aa, Staphylococcus aureus
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKNPMS

SEQ ID NO: 30485 - protein, 250 aa, Staphylococcus aureus
ILVISTPNVLAESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30486 - protein, 239 aa, Staphylococcus aureus
ESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 30487 - protein, 261 aa, Staphylococcus aureus
PLQMKKTAFTLLLFIALTLTTSPLVNGSEKSEEINEKDLRKKSELQGTALGNLKQIYYYNEKAKTENKESHDQFLQHTILFKGFFTDHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQYSNTLLRIYRDNKTISSENMHIDIYLYTSY

SEQ ID NO: 30488 - protein, 677 aa, Staphylococcus aureus
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELG

SEQ ID NO: 30489 - protein, 741 aa, Staphylococcus aureus
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELG

SEQ ID NO: 30490 - protein, 201 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEA

SEQ ID NO: 30491 - protein, 152 aa, Staphylococcus aureus
FKSKNVDVYAIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLY

SEQ ID NO: 30492 - protein, 109 aa, Staphylococcus aureus
NLFVVYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30493 - protein, 107 aa, Staphylococcus aureus
FVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 30494 - protein, 239 aa, Staphylococcus aureus
ESQPDPTPDELHKSSEFTGTMGNMKYLYDDHYVSATKVMSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30495 - protein, 319 aa, Staphylococcus aureus
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 30496 - protein, 241 aa, Staphylococcus aureus
MINKIKILFSFLALLLSFTSYAKAEDLHDKSELTDLALANAYGQYNHPFIKENIKSDEISGEKDLIFRNQGDSGNDLRVKFATADLAQKFKNKSVDIYGASFYYKCEKISENISECLYGGTTLNSEKLAQERVIGANVWVDGIQKETELIRTNKKNVTLQELDIKIRKILSDKYKIYYKDSEISKGLIEFDMKTPRDYSFDIYDLKGENDYEIDKIYEDNKTLKSDDISHIDVNLYTKKKV

SEQ ID NO: 30497 - protein, 261 aa, Staphylococcus aureus
MKLFAFIFICVKSCSLLFMLNGNPRPEQLNKASEFSGLMDNMRYLYDDKHVSETNIKAQEKFLQHDLLFKINGSKIDGSKILKTEFNNKSLSDKYKNKNVDLFGTNYYNQCYFSADNMELNDGRLIEKTCMYGGVTEHDGNQIDKNNLTDNSHNILIKVYENERNTLSFDISTNMKNITAQEIDYKVRNYLLKHKNLYEFNSSPYESGYIKFIEGNGHSFWYDMMPESGEKFYPTKYLLIYNDNKTVESKSINVEVHLTKK

SEQ ID NO: 30498 - protein, 261 aa, Staphylococcus aureus
MKLFAFIFICVKSCSLLFMLNGNPRPEQLNKASEFSGLMDNMRYLYDDKHVSETNIKVQEKFLQHDLLFKINGSKIDGSKILKTEFNNKSLSDKYKNKNVDLFGTNYYNQCYFSADNMELNDGRLIEKTCMYGGVTEHDGNQIDKNNLTDNSHNILIKVYENERNTLSFDISTNMKNITAQEIDYKVRNYLLKHKNLYEFNSSPYESGYIKFIEGNGHSFWYDMMPESGEKFYPTKYLLIYNDNKTVESKSINVEVHLTKK

SEQ ID NO: 30499 - protein, 261 aa, Staphylococcus aureus
MKLFAFIFICVKSCSLLFMLNGNPRPEQLNKASEFTGLMDNMRYLYDDKHVSETNIKAQEKFLQHDLLFKINGSKIDGSKILKTEFNNKSLSDKYKNKNVDLFGTNYYNQCYFSADNMELNDGRLIEKTCMYGGVTEHDGNQIDKNNLTDNSHNILIKVYENERNTLSFDISTNKKNITAQEIDYKVRNYLLKHKNLYEFNSSPYETGYIKFIEGNSHSFWYDMMPESGEKFYPTKYLLIYNDNKTVESKSINVEVHLTKK

SEQ ID NO: 30500 - protein, 222 aa, Staphylococcus aureus
DELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIESENSFWYDMMPAPGDKFDQSKYLMMYNDNKLVDSKDVKM

SEQ ID NO: 30501 - protein, 222 aa, Staphylococcus aureus
PDELHKASKFTGLMENMKVLYDDRYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGKLQNVLIRVYENKRNTISFEVQTDKKSVTAQELDIKARNFLINKKNLYEFNSSPYETGYIKFIENNGNTFWYDMMPAPGDKFEQSKYLMMYNDNKTVDSKSVK

SEQ ID NO: 30502 - protein, 214 aa, Staphylococcus aureus
DELHKASKFTGLMENMKVLYDDRYVSATKVKSVDKFLAHDLIYNISDKKLKNYDKVKTELLNEDLAKKYKDEVVDVYGSNYYVNCCFSSKDNVGKVTGGKTCMYGGITKHEGNHFDNGNLQNVLIRVYENKRNTISFEVQTDKKSVTAQELDIKARSFLINKKNLYEFNSSPYETGYIKFIENNGNTFWYDMMPAPGDKFDQSKYLMMYNDNKT

SEQ ID NO: 30503 - protein, 219 aa, Staphylococcus aureus
KEKDLHKKSELQGVALDNLRQIYYHNGKAITENKESDNQFLQHTILFNGFFTDHPWYNDLLVDFDSKVLADKYKGKKVDLYGAYYGYQCAGGTPNKTACMYGGVTLHDNNRLTEEKKVPINLWLDGKQNTVPLETVKTNKKEVTVQELDLQARHYLHGKYNLYNSDTFDGKVQRGLIVFHTSTEPSVNYDLFGAQGQYSNTLLRIYRDNKTINSENMHI

SEQ ID NO: 30504 - protein, 195 aa, Staphylococcus aureus
MKKLSTVIIILILEIVFHNINYANSQPDPKIDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYE

SEQ ID NO: 30505 - protein, 251 aa, Staphylococcus aureus
MRLFCIAAIIITLLCLINNNYVNADVDKNDLKKKSDIDSSKLFNLTSYYTDITWQLDESNKISTDQLLNNTIILKDIDISVLKTSSLKVEFNSSDLANQFKGKNIDIYGLYYGNKCVGLTEEKTSCLYGGVTIYDGNQLDEERVIGVNVFKDGIQQEGFVIKTKKAKVTVQELDTKVRFKLENLYKIYNKDTGNIQKGCIFFHSNNHQNQSFYYDLYNIKGSVGAEFFQFYSDNRTVSSSNYHIDVFLYKD

SEQ ID NO: 30506 - protein, 261 aa, Staphylococcus aureus
MKLFAFIFICVKSCSLLFMLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVFENERNSLSFDIPTNKKNITAQEIDYKVRNYLLKHKNLYEFNSSPYETGYIKFIEGNGHSFWYDMMPESGEKFYPTKYLLIYNDNKTVESKSINVEVHLTKK

SEQ ID NO: 30507 - protein, 268 aa, Staphylococcus aureus
MKKRIFILIFSLTLTLLITPLVYSDSKNETIKEKNLHKKSELSSITLNNLRHIYFFNEKGISEKIMTEDQFLDYTLLFKSFFISHSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFGGKIQKGLIVFHTSKEPLVSYDLFNVIGQYPDKLLKIYQDNKIIESENMHIDIYLYTSLIVLISLPLVL

SEQ ID NO: 30508 - protein, 259 aa, Staphylococcus aureus
MLNKILLLLFSVTFMLLFFSLHSVSAKPDPRPGELNRVSDYKKNKGTMGNVESLYKDKAVIAENVKNTRQFLGHDLIFPIPYSEYKEVKSEFINKKTADKFKDKRLDVFGIPYFYTCLVPKNESREEFIFDGVCIYGGVTMHSTADSISKNIIVPVTVDNKQQFSFTISTNKKTVTVQELDYKVRNWLTNNKKLYEFDGSAYETGYIKFIEQNKDSFWYDLFPKKDLVPFIPYKFVNIYGDNKTIDASSVKIEVHLTTM

SEQ ID NO: 30509 - protein, 258 aa, Staphylococcus aureus
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGDCCMYGGLTFNSSENERDKLITVQVIIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30510 - protein, 2276 aa, Staphylococcus aureus
MGNKQGFLPNKLNKYSIRKFTVGTASLLVGTTLFFGIGSEAQAAELDTITKEDVKSQDKGEALDIKNIKESEKDVTTEDDNNAEVQNSAQTVDKSENSNDTAVESTNDSVKTDETKETSENKSAQDDDNIKEDSNTQEESTNTSSQSSEVPQTKKDTNETSETAIDEDASTKEQNNKDNDTAQDDDNIKEDSNTQEESTNTSSQSSEVPQTKKEQPDKSSNSIKEPDKQQEEVAKEEKAITEIADKNKELELKNNKTDKNEESELESNLSSSENKKDTVESFLNSQLSDSETKKIMENANIDYDKATDEEINTEILRASLIEMANNKKKTETLATPQRTMFRAMATPTALRAAVNQDEELQKSLGYTDNYTFASMLFDPGKLDSDDALNSNIIPFDLHSYMSGANSGNRYKIDLKLDPIIAEHVTKISANPSGSNKPVEFVRNKDENGNLTDTWEVNFIRANDGLFGGAEILSQYTAKNGKIELDDTVGNIISNAGNLSNNKLNHQVFVRDSRENKIVRTSESSGYFLTKADDDLVNLENNVSTENNNAFKASSGSATYNENVGEFGGILIDQQIMKNGIFSYSKTKANQWAYNYQIDKDLLPYIEGVELHQYDYKGLNGFDKNYDAKNKVADLTIDEVGNGTITSDNLNKLIEFNNALPETVGVRVVLKLNKSVNNILTKDAKYDSEGNLIRETTKQKEDFTFAGYLTDSKGALINNTLGTSTLALQDYDKDGLLDRYERQLSLSDAENEDTDGDGKNDGDEVVNYKTSPLVGKPQAADITTEDTVVSGSVPLKEGAATQTAKVINAEGTTVGTATVNSDGTFSVSIPNSPEGTYTIAIDSPNYDNDEVNTFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTLDEVNTDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNGDLNGGEELQVTATDKDGNTSEPSSANVTDTTASDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPKLTNVTDTTASDAPTVNDVTSDASQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNGDLNGGEKLQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSEPSSANVTDTTAPDAPTVNDVTSDATQVTGQAEPNSTVKLTFPDGTTATGTADDQGNYTIDIPSNVDLNGGEELQVTATDKDGNTSESTNTTIIDSDDNSDNGNNSGAGDTSDSDDNSGNGDNSGAGDNSDSDDNSDNGNNSGAGDNSDSDDNSDNEDNSSSNKDSINQDSNVNSNDSKHDKQNELPETGEKEVRNGTLFGTLFAGLGSLLLFTKRRRKENDKK

SEQ ID NO: 30511 - protein, 691 aa, Staphylococcus aureus
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 30512 - protein, 266 aa, Staphylococcus aureus; identical to SEQ ID NO: 30401

SEQ ID NO: 30513 - protein, 44 aa, Staphylococcus aureus
MSCLILRIFILIKEGVISMAQDIISTIGDLVKWIIDTVNKFTKK

SEQ ID NO: 30514 - protein, 54 aa, Staphylococcus aureus
ANDTEDIGKGSDIEIIKRTEDKTSNKWGVTQNIQFDFVKDRNYTVHEIKVKGQN

SEQ ID NO: 30515 - protein, 258 aa, Staphylococcus aureus
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGDCCMYGGLTFNSSENERDKLITVQVIIDNRQSLGFTITTNKNMVTIQELDYKARHWLTKEKKLGEFDGSAFESGYIKFTEKNNTSFWFDLFPKKELVPFVPYKFLNIYGDNKVVDSKSIKMEVFLNTH

SEQ ID NO: 30516 - protein, 2186 aa, Staphylococcus aureus
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30517 - protein, 1972 aa, Staphylococcus aureus
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAGK

SEQ ID NO: 30518 - protein, 258 aa, Staphylococcus aureus
MKKLSTVIIILILEIVFHNINYANSQPDPKIDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30519 - protein, 258 aa, Staphylococcus aureus; identical to SEQ ID NO: 30410

SEQ ID NO: 30520 - protein, 242 aa, Staphylococcus aureus
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGHGLPVSFLKIYEDNTIIESEKFHLDVEISYVDSN

SEQ ID NO: 30521 - protein, 243 aa, Staphylococcus aureus
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGNGLPVSFLKIYEDNKIIESEKFHLDVEMSYVDSNK

SEQ ID NO: 30522 - protein, 242 aa, Staphylococcus aureus
MKKIKYSFILVFILFFNIKDLSYAQGDIGVGNLRNFYTKYDYIDLKGVTDKNLPIANQLEFSTGTNDLISESNNWDEISKFKGKKMDIFGIDYNGPCKTKYMYGGATLSGQYLNSARKIPINLWINGKHKTISTDKIATNKKLVTAQEIDVKLRRYLQEEYNIYGHNNNGKGKEYGYKSKFYSGFNKGKVLFHLNDEKSFSYDLFYTGDGLPVSFLKIYEDNKIIESEKFHLDVEISYVDSN

SEQ ID NO: 30523 - protein, 283 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIA

SEQ ID NO: 30524 - protein, 141 aa, Staphylococcus aureus
MKLKSFVTATLALGLLSTVGAALPSHEASADSNNGYKELTMDGKHTVPYTISVDGITALHRTYFVFPENKKVLYQEIDSKVKNELASQRGVTTEKINNAQTATYTLTLNDGNKKVVNLKKNDDVKNSIDPSTIKQIQIVVK

SEQ ID NO: 30525 - protein, 247 aa, Staphylococcus aureus
MKDTIVKFLSAFLVISSISLIDTSFSSKYNKISIAAETKNFTDLVEATKWGNSLIKSAKYSSKDKMAIYNYTKNSSPINTPLRSANGDVNKLSENIQEQVRQLDSTISKSVTPDSVYVYRLLNLDYLSSITGFTREDLHMLQQTNNGQYDEALVSKLNNLMNSRIYRENGYSSTQLVSGAALAGRPIELKLELPKGTKAAYIDSKELTAYPGQQEVLLPRGTEYAVGSVKLSDNKRKIIITAVVFKK

SEQ ID NO: 30526 - protein, 51 aa, Staphylococcus aureus [sequence omitted]

SEQ ID NO: 30527 - protein, 218 aa, Staphylococcus aureus
QGDIGVGNLRNFYTKHDYIDLKGVTDKNLPIANQLEFSTGTNDLISESNNWDEISKFKGKKLDIFGIDYNGPCKSKYMFGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 30528 - protein, 217 aa, Staphylococcus aureus
EDLHDKSELTDLALANAYGQYNHPFIKENIKSDEISGEKDLIFRNQGDSGNDLRVKFATADLAQKFKNKNVDIYGASFYYKCEKISENISECLYGGTTLNSEKLAQERVIGANVWVDGIQKETELIRTNKKNVTLQELDIKIRKILSDKYKIYYKDSEISKGLIEFDMKTPRDYSFDIYDLKGENDYEIDKIYEDNKTLKSDDISHIDVNLYTKKKV

SEQ ID NO: 30529 - protein, 233 aa, Staphylococcus aureus
QPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30530 - protein, 234 aa, Staphylococcus aureus
MNKKLLMNFFIVSPLLLATIATDFTPVPLLSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30531 - protein, 256 aa, Staphylococcus aureus
MPIWRCNIKKGAIKMNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDAENFHLDVEISYEKTE

SEQ ID NO: 30532 - protein, 2283 aa, Staphylococcus aureus
MSKRQKAFHDSLANEKTRVRLYKSGKNWVKSGIKEIEMFKIMGLPFISHRIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASAATTTAVTANTITVNKDNLKQYMTASGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNKSTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTAESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDPTSDSKSASTASSESISQSVSTSTSGSVSTSTSLSTSNSERTSTSMSDSTSLSTSESDSTSDSTSTSDSISEAISGSESTSISLSESNSTGDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSISTSESDSQSTSTYTSQSTSQSESTSTSTSISDSTSISKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSAPTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSLSGSESVSESTSLSDSISMSDSTSTSDSDSLSGSISLSGSTSLSTSDSLSDSKSLSSSQSMSGSESTSTSVSDSQSSSASNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSASMSQDKSDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSDSQSTLSATSEATKHNGTRAQSEERLPDTGESIKQNGLLGGIMTLLVGLGLMKRKKKKDENDQDDSQA

SEQ ID NO: 30533 - protein, 247 aa, Staphylococcus aureus
MKRKLFFKIIFVLSLVLSIHSINDRTTELSNIALADDVKNFTDLTEATNWGNKLIKQANYSSKDKEAIYNYTKYSSPINTPLRSSQGDISNFSADLQEKILRLDRLISKSSTSDSVYVYRLLNLDYLSSVKGFSSEDLELLYKTENGKYNEELVKKLNNIMNSKIYTEYGYSSTQLVKGAALAGRPIELKLQLPKGTKAAYIDSKNLTAYPGQQEILLPRGTDYTINTVKLSDDHKRILIEGIVFKK

SEQ ID NO: 30534 - protein, 190 aa, Staphylococcus aureus
MFRLKKWYLKQKGYFCRVGEKWDNSNLSHENIHSYVDRVLEYETETRRNGQPTEEYILASSGEKINEDLRSGTNDHKEILEVFDKYKVKEDITTYRTVSPRIYKLMEKNAKNLNGVDLFELGILHTSLIKGYESREEGYKLRVKVKKGTPAFYVGNLTGEESHYYEVIVVNNLKLKIISIEDYYINCEVV

SEQ ID NO: 30535 - protein, 259 aa, Staphylococcus aureus
MRKVFILITLLFGYSSYSLLEAKAETQNDPNISELNKSSQYTGSWHNIWYLYNSDPVNAKKIKLSDKFLSHEFIVPINNPSHYDYVKTELKDSTMASSFDGKEVDIFGVNYFDQCYFLNENIQCDSNQGAGSKKTCMYGGITLNENNTNNRIQPIVVKVYENDSVTLSFDINIDKETVTIQELDYKVRNKLISKINLYHLGGTSYETGYIKFIENGNRYYWYDMMPDPGFTQSKYLMIYRGNETVESAKTEIEVHLTKK

SEQ ID NO: 30536 - protein, 242 aa, Staphylococcus aureus
MKKLISILLINIIILGVSNSASAQGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKFVTAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 30537 - protein, 242 aa, Staphylococcus aureus
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYDDNKTIDTENFHLDVEISYEKTE

SEQ ID NO: 30538 - protein, 327 aa, Staphylococcus aureus
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 30539 - protein, 311 aa, Staphylococcus aureus
MFKKQMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30540 - protein, 212 aa, Staphylococcus aureus
AETKNFTDLVEATKWGNSLIKSAKYSSKDKMAIYNYTKNSSPINTPLRSANGDVNKLSENIQEQVRQLDSTISKSVTPDSVYVYRLLNLDYLSSITGFTREDLHMLQQTNNGQYNEALVSKLNNLMNSRIYRENGYSSTQLVSGAALAGRPIELKLELPKGTKAAYIDSKELTAYPGQQEVLLPRGTEYAVGSVKLSDNKRKIIITAVVFKK

SEQ ID NO: 30541 - protein, 258 aa, Staphylococcus aureus
MKKLSTVIIILILEIVFHNMNYVNAQPDLKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30542 - protein, 258 aa, Staphylococcus aureus
MKNIKKLMRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 30543 - protein, 108 aa, Staphylococcus aureus
MYGGVVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 30544 - protein, 239 aa, Staphylococcus aureus
MKRILIIVVLLFCYSQNHIATADVGVLNLRNYYGSYPIEDHQSINPENNHLSHQLVFSMDNSTVTAEFKNVDDVKEFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 30545 - protein, 261 aa, Staphylococcus aureus
MIKNSKVMLNVLLLILNLIAICSVNNAYANEEDPKIESLCKKSSVDPIALHNINDDYINNRFTTVKSIVSTTEKFLDFDLLFKSINWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 30546 - protein, 234 aa, Staphylococcus aureus
MNKKLLMKFFIVSPLLLATIATGFTPVPLSSNQIIKTAKASTNDNIKDLLDWYSSGSDAFTNSEVLDNSLGSMRIKNTDGSISLIIFPSPYYSPTFSKGEKVDLNTKRTKKSQHTSEGTWIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 30547 - protein, 271 aa, Staphylococcus aureus
MKEIKMNKSRFISCVILIFALILVLFTPNVLAESQPDPTPDELHKASKFTGLMENMKVLYDDRYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGKLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 30548 - protein, 240 aa, Staphylococcus aureus
MKKRLLFVIVITLFIFSSNHTVLSNGDVGPGNLRNFYTKYEYVNLKNVKDKNSPESHRLEYSYKNDTLYAEFDNEYITSDLKGKNVDVFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEISKR

SEQ ID NO: 30549 - protein, 26 aa, Staphylococcus aureus
MAQDIISTISDLVKWIIDTVNKFTKK

SEQ ID NO: 30550 - protein, 238 aa, Staphylococcus aureus
MNKNIIIKSIAALTILTSVTGVGTTMVEGIQQTAKAEHNVKLIKNTNVAPYNGIVSIGSGTGFIVGKNTIVTNKHVVAGMEIGAQIIAHPNGEYNNGGFYKVKKIVRYAGQEDIAILHVEDKAIHPKNRNFKDYTGILKIASEAKENERISIVGYPEPYINKFQMYESTGKVLSVKGNMIISDAFVEPGNSGSAVFNSKYEVVGVHFGGNGPANKSTKGYGVYFSPEIKKFIADNLIK

SEQ ID NO: 30551 - protein, 235 aa, Staphylococcus aureus
MNKNVMIKGLTALTILTSLGFAENISDQPHSIAKAEKNIKEVTDATKAPYNSVVAFAGGTGVVVGKNTIVTNKHIAKSNDIFKNRVSAHHSSKGKGGGNYDVKDIVEYPGKEDLAIVHVHETSTEGLNFNKNVSYTKFAEGAKMKDRISVIGYPKGAQTKYKMFESTGTINHINGTFMEFDAYAQPGNSGSPVLNSKNELVGILYAGSGKDESEKNFGVYFTPQLKEFIQNNIEK

SEQ ID NO: 30552 - protein, 29 aa, Staphylococcus aureus
SFLKIYEDNKIIESEKFHLDVEISYVDSN

SEQ ID NO: 30553 - protein, 198 aa, Staphylococcus aureus
MMTLQIHTGGINLKKKNIYSIRKLGVGIASVTLGTLLICGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNVSSKA

SEQ ID NO: 30554 - protein, 175 aa, Staphylococcus aureus
MNKTSKVCVAATLALGTLIGVTVVENSAPTSKQAQAAITPYYTYNGYIGNNANFILDKNFINAIKYDNVKFNGIKLAKTNTIKKVEKYDQTFKGVSAKGNEASQLQFVVKNNISLKDIQKAYGKDLKKENGKTKEADSGIFYYQNAKKTLGIWFVVDHNRVVEVTVGHTPYKTSK

SEQ ID NO: 30555 - protein, 1698 aa, Staphylococcus aureus
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKANTTEQASTEEKADTTEQATTEEAPKAEGTDKVETEEAPKAEETDKATEEAPKTEETDKATTEEAPKAEETDKATEEAPKTEETDKATTEEAPAAEETSKAATEEAPKAEETSKAATEEAPKAEETEKTATEEAPKTEETDKVETEEAPKAEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGTLTAFNTNFNPNTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFAPEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDADSDSDADSDSDADSDSDADSDSDADSDSDSDSDSDSDSDSDADSDSDSDSDSDADSDSDADSDSDADSDSDSDADSDSDSDSDSDADSDSDSDSDSDSDADSDSDADSDSDADSDSDADSDSDSDSDSDADSDSDSDADSDSDSDSDSDADSDSDADSDSDADSDSDADSDSDSDSDSDSDSDSDADSDSDADSDSDADRDHNDKTDKPNNKELPDTGNDAQNNGTLFGSLFAALGGLFLVGRRRKNKNNEEK

SEQ ID NO: 30556 - protein, 254 aa, Staphylococcus aureus
MTVEERSNTAKVDILGVDFDNTTMLQMVENIKTFFANQSTNNLFIVTANPEIVNYATTHQAYLELINQASYIVADGTGVVKASHRLKQPLAHRIPGIELMDECLKIAHVNHQKVFLLGATNEVVEAAQYALQQRYPNISFAHHHGYIDLEDETVVKRIKLFKPDYIFVGMGFPKQEEWIMTHENQFESTVMMGVGGSLEVFAGAKKRAPYIFRKLNIEWIYRALIDWKRIGRLKSIPIFMYKIAKAKRKIKKAK

SEQ ID NO: 30557 - protein, 2478 aa, Staphylococcus aureus
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPKANQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATASNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATRANEQKALIAQTADATTEEKEQANQQVDAHLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNLSQKDDTATADTNDTQPSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 30558 - protein, 1795 aa, Staphylococcus aureus
MNLFRQQKFSIRKFNVGIFSALIATVTFISINPTTASAAEQNQPAQNQPAQPADANAQPNANAGAQANPAAQPAAPANQGQPAAQPANQGGQANPAGGAAQPVGGAAQPAAGTAQPAGQGNQADPNNAAQAQPGNQAAPANQAGQGNNQATPANQTQPANAPAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYINDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDAANTNSAVTTAKDNGIAAINQVQAATTKKSDAKAEIAQKASERKTAIEAMNDSTTEEQQAAKEKVDQAVLSANADIDNAAANTDVDNAKTTNEATIAAITPDANVKPQAKQAIADKVQAQEKAIDANNGSTTEEKAAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKAIQAIAAATTNAQVDEAKTNAEAAINAVTPKVVKKQTAKDEIDQLQATQTNVINNDQNATTEEKEAAIQQLATAVTDAKNNITAATDDNGVDQAKDAGKNSIQSTQPATSVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQ

SEQ ID NO: 30559 - protein, 2478 aa, Staphylococcus aureus
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNLSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 30560 - protein, 231 aa, Staphylococcus aureus
MKLKTLAKATLALGLLTTGVITSEGQAVQAKEKQERVQHLYDIKDLHRYYSSESFEFSNISGKVENYNGSNVVRFNQENQNHQLFLLGKDKEKYKEGIEGKDVFVVKELIDPNGRLSTVGGVTKKNNKSSETNTHLFVNKVYGGNLDASIDSFSINKEEVSLKELDFKIRQHLVKNYGLYKGTTKYGKITINLKDGEKQEIDLGDKLQFERMGDVLNSKDINKIEVTLKQI

SEQ ID NO: 30561 - protein, 231 aa, Staphylococcus aureus
MKLKTLAKATLALSLLTTGVITLESQAVKAAEKQERVQHLYDIKDLYRYYSAPSFEYSNISGKVENYNGSNVVRFNQKDQNHQLFLLGKDKEQYKEGLQGKDVFVVQELIDPNGRLSTVGGVTKKNNKTSETKTHLLVNKVDGGNLDASIDSFLIQKEEISLKELDFKIRQQLVEKYGLYQGTSKYGKITINLKDEKREVIDLSDKLEFERMGDVLNSKDIKGISVTINQI

SEQ ID NO: 30562 - protein, 584 aa, Staphylococcus aureus
MKFHGSRATTLALGVIASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKISKLVIKILENNVKSVLKSNRGITDVDLRLSKQAKFTVNFKNGTKKVIDLKAGIYTANLINTGDIKNININVETKKQAKDKEAKVNNQVPYSINLNGTTTNIQSNLAFSNKPWTNYKNLTTKVKSVLKSDRGVSERDLKHAKKAYYTVYFKNGGKRVIHLNSNIYTANLVHAKDVKRIEVTVKTVSKVKAERYVPYTIAVNGASNPTLSDLKFTGDSRVSYSDITKKVKSVLKHDRGINDIELKFAKQAKYTIHFKNGKTQVVDLKSDIFTRNLFSVKDIKKIDINVKQHTKSNKALNKVTNKATKVKFPVTINGFSNLVSNEFAFLHPHKITTNDLNAKLRLALASDQGITKHDIGLSERTVYKVYFKDGSSKFVDLKAAKQDSKVFKATDIKKVDIEIKF

SEQ ID NO: 30563 - protein, 689 aa, Staphylococcus aureus
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKANAERYVPYTIAVNGTSTPNLSDLKFKGDSRVSYSDITKKVKSVLKYDRGIGERELKYAKKATYTVHFKNGTKKVINLNSKISQLNLLFVKDIKKIDVDVKTGSKAKADSYVPYTIAVNGTSTPIASKLRLSNKQLIGYQDLNKKVKSVLKHDRGINDIELKFAKQAKYTVHFKNGKTQVVDLKSDIFTRNLFSVKDIKKIDIDVKQHTKSNKALNKVANIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 30564 - protein, 227 aa, Staphylococcus aureus
MKLTALAKVTLALGILTTGTLTTEAHSGHAKQNQKSVNKHDKEALHRYYTGNFKEMKNINALRHGKNNLRFKYRGMKTQVLLPGDEYRKYQQRRHTGLDVFFVQERRDKHDISYTVGGVTKTNKTSGFVSTPRLNVTKEKGEDAFVKGYPYDIKKEEISLKELDFKLRKHLIEKYGLYKTLSKDGRIKISLKDGSFYNLDLRTKLKFKHMGEVIDSKQIKDIEVNLK

SEQ ID NO: 30565 - protein, 232 aa, Staphylococcus aureus
MKLTAIAKATLALGILTTGVMTAESQTVNAKVKLDETQRKYYINMLKDYYSQESYESTNISVKSEDYYGSNVLNFNQRNKNFKVFLIGDDRNKYKELTHGRDVFAVPELIDTKGGIYSVGGITKKNVRSVFGYVSHPGLQVKKVDPKDGFSIKELFFIQKEEVSLKELDFKIRKMLVEKYRLYKGASDKGRIVINMKDEKKHEIDLSEKLSFDRMFDVLDSKQIKNIEVNLN

SEQ ID NO: 30566 - protein, 231 aa, Staphylococcus aureus
MKLKTLAKATLALGLLTTGVITSEGQAVQAAEKQERVQHLHDIRDLHRYYSSESFEYSNVSGKVENYNGSNVVRFNPKDQNHQLFLLGKDKEQYKEGLQGQNVFVVQELIDPNGRLSTVGGVTKKNNKTSETNTPLFVNKVNGEDLDASIDSFLIQKEEISLKELDFKIRQQLVNNYGLYKGTSKYGKIIINLKDENKVEIDLGDKLQFERMGDVLNSKDIRGISVTINQI

SEQ ID NO: 30567 - protein, 234 aa, Staphylococcus aureus
MKMTAIAKASLALSILATGVITSTAQTVNASEHESKYENVTKDIFDLRDYYSRASKELKNVTGYRYSKGGKHYLIFDKNRKFTRIQIFGKDIERIKKRKNPGLDIFVVKEAENRNGTVYSYGGVTKKNQGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIEKIEANIR

SEQ ID NO: 30568 - protein, 172 aa, Staphylococcus aureus
GFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 30569 - protein, 258 aa, Staphylococcus aureus
MKKLSTVIIILILEIVFHNINYANAQPDPKIDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30570 - protein, 492 aa, Staphylococcus aureus
  strain 04-02981
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNNKPGKEDGNKPGKEDNNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30571 - protein, 241 aa, Staphylococcus aureus
  strain 04-02981
MKKLATVGSLIVTSTLVFSSMPFQNAHADTTSMNVPNKQSQNVQNHRPYGGVVPQGMTQAQYTELEKTLPQLSAGSNMQDYNMKLYDATQNIADKYNVIITTNVGVFKPHAVRDMNGHALPLTKDGNFYQTNVDANGVNHGGSEMVQNKTGHMSQQDHMNQNTHMNQQPQIQQGHMQSSNHQMMSPKANMHSSNHQMNQSNKKVLPAAGESMTSSILTASIAALLLVSGLFLAFRRRSTNK

SEQ ID NO: 30572 - protein, 309 aa, Staphylococcus aureus; identical to SEQ ID NO: 30406
  strain 04-02981

SEQ ID NO: 30573 - protein, 315 aa, Staphylococcus aureus
  strain 04-02981
MLKNKILATTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 30574 - protein, 325 aa, Staphylococcus aureus; identical to SEQ ID NO: 30407
  strain 04-02981

SEQ ID NO: 30575 - protein, 691 aa, Staphylococcus aureus; identical to SEQ ID NO: 30511
  strain 04-02981

SEQ ID NO: 30576 - protein, 203 aa, Staphylococcus aureus
  strain 04-02981
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYTVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 30577 - protein, 226 aa, Staphylococcus aureus
  strain 04-02981
MKFKAIAKASLALGMLATGVITSNVQSVQAKTEVKQQSESELKHYYNKPVLERKNVTGYKYTEKGKDYIDVIVDNQYSQISLVGSDKDKFKDGDNSNIDVFILREGDSRQATNYSIGGVTKTNSQPFIDYIHTPILEIKKGKEEPQSSLYQIYKEDISLKELDYRLRERAIKQHGLYSNGLKQGQITITMKDGKSHTIDLSQKLEKERMGDSIDGRQIQKILVEMK

SEQ ID NO: 30578 - protein, 231 aa, Staphylococcus aureus
  strain 04-02981
MKMKNIAKISLLLGILATGVNTTTEKPVHAEKKPIVISENSKKLKAYYTQPSIEYKNVTGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 30579 - protein, 356 aa, Staphylococcus aureus
  strain 04-02981
MNMKTIAKTSLALGLLTTGAITVTTQSVKAEKIQSTKVDKVPTLKAERLAMINITAGANSATTQAANTRQERTPKLEKAPNTNEEKTSASKIEKISQPKQEEQKSLNISAMPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 30580 - protein, 292 aa, Staphylococcus aureus
  strain 04-02981
MKITTIAKTSLALGLLTTGVITTTTQEANATTPSSTKVEAPQSTPPSTKVEAPQSKPNATTPPSTKVETPQQTPNATTPSSTKVETPQSPTTKQVPTEINPKFKDLRAYYTKPSLEFKNEIGIILKKWTTIRFMNIVPDYFIYKIALVGKDDKKYDEGVHRNVDVFVVLEEKNKYGVERYSVGGITKSNSKKVDHKAGVRITKEDNKGTISHDVSEFKITKEQISLKELDFKLRKQLIENHNLYGNVGSGKIVINMKNGGKYTFELHKKLQENRMADVIDGTNIDNIEVNIK

SEQ ID NO: 30581 - protein, 234 aa, Staphylococcus aureus
  strain 04-02981
MKMAAIAKASLALGILATGTITSLHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 30582 - protein, 231 aa, Staphylococcus aureus
  strain 04-02981
MKLKTLAKATLALGLLTTGVITSEGQAVHAKEKQERVQHLYDIKDLYRYYSSESFEFSNISGKVENYNGSNVVRFNQEKQNHQLFLLGKDKDKYKKGLEGQNVFVVKELIDPNGRLSTVGGVTKKNNKSSETNTHLFVNKVYGGNLDASIDSFLINKEEVSLKELDFKIRKQLVEKYGLYKGTTKYGKITINLKDEKKEVIDLGDKLQFERMGDVLNSKDIQNIAVTINQI

SEQ ID NO: 30583 - protein, 232 aa, Staphylococcus aureus
  strain 04-02981
MKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 30584 - protein, 232 aa, Staphylococcus aureus
  strain 04-02981
MKLTALAKATLALGILTTGVFTAESKAVHAKVELDETQRKYYINMLHQYYSEESFESTNISVKSEDYYGSNVLNFNQRNKTFKVFLLGDDKNKYKEKTHGLDVFAVPELIDIKGGIYSVGGITKKNVRSVFGFVSNPSLQVKKVDAKHGFSINELFFIQKEEVSLKELDFKIRKMLVEKYRLYKGASDKGRIVINMKDEKKYVIDLSEKLSFDRMFDVMDSKQIKNIEVNLN

SEQ ID NO: 30585 - protein, 227 aa, Staphylococcus aureus
  strain 04-02981
MKFTALAKATLALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 30586 - protein, 227 aa, Staphylococcus aureus
  strain 04-02981
MKLKNIAKASLALGILTTGMITTTAQPVKASTLEVRSQATQDLSEYYKGRGFELTNVTGYKYGNKVTFIDNSQQIDVTLTGNEKLTVKDDDEVSNVDVFVVREGSDKSAITTSIGGITKTNGTQHKDTVQNVNLSVSKSTGQHTTSVTSEYYSIYKEEISLKELDFKLRKHLIDKHDLYKTEPKDSKIRITMKNGGYYTFELNKKLQPHRMGDTIDSRNIEKIEVNL

SEQ ID NO: 30587 - protein, 196 aa, Staphylococcus aureus
  strain 04-02981
MIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 30588 - protein, 444 aa, Staphylococcus aureus
  strain 04-02981
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLIRI

SEQ ID NO: 30589 - protein, 961 aa, Staphylococcus aureus
  strain 04-02981
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 30590 - protein, 1038 aa, Staphylococcus aureus
  strain 04-02981
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 30591 - protein, 233 aa, Staphylococcus aureus
  strain 04-02981
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSDVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 30592 - protein, 211 aa, Staphylococcus aureus
  strain 04-02981
MKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 30593 - protein, 877 aa, Staphylococcus aureus
  strain 04-02981
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 30594 - protein, 953 aa, Staphylococcus aureus
  strain 04-02981
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 30595 - protein, 1385 aa, Staphylococcus aureus
  strain 04-02981
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 30596 - protein, 1153 aa, Staphylococcus aureus
  strain 04-02981
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30597 - protein, 2271 aa, Staphylococcus aureus
  strain 04-02981
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 30598 - protein, 681 aa, Staphylococcus aureus
  strain 04-02981
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 30599 - protein, 434 aa, Staphylococcus aureus [sequence omitted]

SEQ ID NO: 30600 - protein, 905 aa, Staphylococcus aureus
  strain 04-02981
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 30601 - protein, 645 aa, Staphylococcus aureus
  strain 04-02981
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKAVKPAAKATNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 30602 - protein, 350 aa, Staphylococcus aureus
  strain 04-02981
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 30603 - protein, 109 aa, Staphylococcus aureus
  strain 04-02981
MKKNFIGKSILSIAAISLTVSTFAGESHAQTKNVEAAKKYDQYQTNFKKQVNKKVVDAQKAVNLFKRTRTVATHRKAQRAVNLIHFQHSYEKKKLQRQIDLVLKYNTLK

SEQ ID NO: 30604 - protein, 165 aa, Staphylococcus aureus; identical to SEQ ID NO: 30418
  strain 04-02981

SEQ ID NO: 30605 - protein, 319 aa, Staphylococcus aureus
  strain 04-02981
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 30606 - protein, 238 aa, Staphylococcus aureus
  strain 04-02981
MSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYTENRNKGKLKITGGGNNYTIDLSKRLHSDLANVYVKNPNKITVDVLFD

SEQ ID NO: 30607 - protein, 241 aa, Staphylococcus aureus
  strain 04-02981
MNNNITKKIILSTTLLLLGTAFTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGTDNNYTIDLSKRLPSTDANRYVKKPQNAKIEVILEKSN

SEQ ID NO: 30608 - protein, 241 aa, Staphylococcus aureus
  strain 04-02981
MKKNIMNKLVLSTALLLLGTTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 30609 - protein, 372 aa, Staphylococcus aureus
  strain 04-02981
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 30610 - protein, 62 aa, Staphylococcus aureus
  strain 04-02981
MYEQGGDIVKGYVKYHNDDEQNVEYDFYNLNGEYGYEVLKMYADNKTINRDKLHLDIYLFKS

SEQ ID NO: 30611 - protein, 157 aa, Staphylococcus aureus
  strain 04-02981
MSQPVYHLCLALKCKLIIVLGEFEVKYLTGFILILLLEGIFTNSASAIEYSDLHHKSKFDSKRLSNAKMSFINPTQLENKNTNDRLLKHDLLFHDMFVNVASKKDFKVEFENEALSKKFINKNIDIYAGSYSYECHGGATNKTQCSYGGVTLSDNNK

SEQ ID NO: 30612 - protein, 291 aa, Staphylococcus aureus; identical to SEQ ID NO: 30390
  strain 04-02981

SEQ ID NO: 30613 - protein, 891 aa, Staphylococcus aureus
  strain 04-02981
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIVDKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 30614 - protein, 2186 aa, Staphylococcus aureus
  strain 04-02981
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQVDIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30615 - protein, 331 aa, Staphylococcus aureus
  strain 04-02981
MSNQFKSEEERRQWEQFQAFQNQQNQQHQQYGQKKSKKGWFWGCGGCLVLFILIIIGISACTAGVTGNLGGNSSKEANKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDASTE

SEQ ID NO: 30616 - protein, 327 aa, Staphylococcus aureus
  strain 04-02981
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 30617 - protein, 311 aa, Staphylococcus aureus
  strain 04-02981
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30618 - protein, 258 aa, Staphylococcus aureus
  strain 04-02981
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKLDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 30619 - protein, 258 aa, Staphylococcus aureus; identical to SEQ ID NO: 30542
  strain 04-02981

SEQ ID NO: 30620 - protein, 136 aa, Staphylococcus aureus
  strain 04-02981
MKKTCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 30621 - protein, 242 aa, Staphylococcus aureus; identical to SEQ ID NO: 30399
  strain 04-02981

SEQ ID NO: 30622 - protein, 239 aa, Staphylococcus aureus
  strain 04-02981
MKRILIIVVLLFCYSQNHIATADVGVLNLRNYYGSYPIEDHQSINPENNHLSHQLVFSMDNSTVTAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 30623 - protein, 260 aa, Staphylococcus aureus
  strain 04-02981
MKNSKVMLNVLLLILNLIAICSVNNAYANEEDPKIESLCKKSSVDPIALHNINDDYINNRFTTVKSIVSTTEKFLDFDLLFKSINWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 30624 - protein, 106 aa, Staphylococcus aureus
  strain 04-02981
MKKKINKSNNVKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 30625 - protein, 260 aa, Staphylococcus aureus
  strain 04-02981
MSKIKKTTFILLSFIALTLITSPFVNCSEKSEEINGKDLQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 30626 - protein, 289 aa, Staphylococcus aureus
  strain 04-02981
MRDSKPNKYCCYKVSMYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30627 - protein, 338 aa, Staphylococcus aureus
  strain 04-02981
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHDVKFVKVLNDNEKK

SEQ ID NO: 30628 - protein, 351 aa, Staphylococcus aureus
  strain 04-02981
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 30629 - protein, 44 aa, Staphylococcus aureus; identical to SEQ ID NO: 30513
  strain 04-02981

SEQ ID NO: 30630 - protein, 231 aa, Staphylococcus aureus
  strain 04-02981
MKKTLLASSLAVGLGIVAGNAGHEAHASEADLNKASLAQMAQSNDQTLNQKPIEAGAYNYTFDYEGFTYHFESDGTHFAWNYHATGANGANMSAQAPATNNVEPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 30631 - protein, 2481 aa, Staphylococcus aureus
  strain 04-02981
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 30632 - protein, 809 aa, Staphylococcus aureus
  strain 04-02981
MTYRMKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 30633 - protein, 141 aa, Staphylococcus aureus
  strain 04-02981
MKLKSFVTATLALGLLSTVGAALPSHEASADSNNGYKELTMDGKHTVPYTISVDGITALHRTYFVFPENKKVLYQEIDSKVKNELASQRGVTTEKINNAQTATYTLTLNDGNKKVVNLKKNDDAKNSIDPSTIKQIQIVVK

SEQ ID NO: 30634 - protein, 1113 aa, Staphylococcus aureus
  strain bovine RF122 / ET3-1
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTTSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPAATAPTSVAPKRVNAKMRFAVAQPAAVASNNVNDLITVTKQTITEGIKDDGVIQAHDGEHIIYTSDFKIDNSVKMGDTMTVKYDKHTLPSDLTDDFSPVDITDPSGEVIAKGTFDVNTNTITYKFTDYVDRYENVNAKLELNSYIDKKTVPNEANINLTFGTADKETSKNVNVEYQKPIVKDESNIQSIFSHLDTTKHEVEQTIYVSPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLEVQQGVRMTTTNKYNYSSYAGYTNTILSTTDSGGGDGTAKPEEKLYKIGDYVWEDVDKDGVQGTDSKEKPMANVLVTLTYPDGTTKSVRTDDKGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30635 - protein, 434 aa, Staphylococcus aureus [sequence omitted]

SEQ ID NO: 30636 - protein, 646 aa, Staphylococcus aureus
  strain bovine RF122 / ET3-1
MSSQKKKISLFAFFLLTVITITLKTYFSYYVDFSLGVKGLVQNLILLMNPYSLVALVLSVFLFFKGKKAFWFMFIGGFLLTFLLYANVVYFRFFSDFLTFSTLNQVGNVESMGGAVSASFKWYDFVYFIDTLVYLFILIFKTKWLDTKAFSKKFVPVVMAASVALFFLNLAFAETDRPELLTRTFDHKYLVKYLGPYNFTVYDGVKTIENNQQKALASEDDLTKVLNYTKQRQTEPNPEYYGVAKKKNIIKIHLESFQTFLINKKVNGKEVTPFLNKLSSGKQQFTYFPNFFHQTGQGKTSDSEFTMDNSLYGLPQGSAFSLKGDNTYQSLPAILDQKQGYKSDVMHGDYKTFWNRDQVYKHFGIDKFYDATYYDMSDKNVVNLGLKDKIFFKDSANYQAKMKSPFYSHLITLTNHYPFTLDEKDATIEKSNTGDATVDGYIQTARYLDEALEEYINDLKKKGLYDNSVIMIYGDHYGISENHNNAMEKLLGEKITPAKFTDLNRTGFWIKIPGKSGGINNEYAGQVDVMPTILHLAGIDTKNYLMFGTDLFSKGHNQVVPFRNGDFITKDYKYVNGKIYSNKNNELITTQPADFEKNKKQVEKDLEMSDNVLNGDLFRFYKNPDFKKVNPSKYKYETGPKANSKK

SEQ ID NO: 30637 - protein, 291 aa, Staphylococcus aureus; identical to SEQ ID NO: 30390
  strain bovine RF122 / ET3-1

SEQ ID NO: 30638 - protein, 893 aa, Staphylococcus aureus
  strain bovine RF122 / ET3-1
MNKHHPKLRSFYSIRKSTLGVASVIVSTLFLITSQHQAQAAENTNTSDKISENQNSNATTTQPPKDTNQTQPATQPANTAKTYPAADESLKDAIKNPAVENKEHDIGPREQVNFLLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTSDQPQATTNMSQPAQPKLSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTALTWKKLEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENNESVMDGFVEHPFYTATLNGQKYVVMKTKDDSYWKDLIVEGKRVTTVSKDTKNNSRTLIFPYIPDKAVYNAIVKVVVANIGYEGQYHVRIINQDIKTKDDDTSQNNTSEHLNGQTVQEDNVTATDTATNNSIETTPREATDKVDLIEPESDMVKDADSSVDKDAHHDVDHLSDMSGNTHFDKYDLKEMDTQIAKDTDKGVDNSVGMSSNVDTDKDSNKNKDKVIQLDHIADKNKVNNTGTETNIDTMKYHPISTIKVTDKKTTEHLPSDIHKTVDKTVKTKEKASTPSKENKLSQSKMLPKTGETTSSQSWWSLYALLGMLALFIPKFRKESK

SEQ ID NO: 30639 - protein, 240 aa, Staphylococcus aureus
  strain bovine RF122 / ET3-1
MNKNVVIKSLATLTILTSVAGIGTTLVEEVQQTAKAENNVTKIKDTNIFPYTGVVAFNSATGFVVGKNTILTNKHVSKNYKVGDRITAHPNSDKSNGGIYSIKKIINYPGKEDVSVIKVEEHAIERGPKGFNFNDNVTPFKYAAGAKAGDRIKVIGYPHPYKNKYVLHESTGPVMSVEGSSIVYSAHTESGNSGSPVLNSNNELVGIHFASDVKNDDNRNAYGVYFTPEIKRFIAENIDK

SEQ ID NO: 30640 - protein, 239 aa, Staphylococcus aureus
  strain bovine RF122 / ET3-1
MNKNIVIKSMAALAILTSVTGINAAVVDETQQIANAEKNVTQVKDTNVFPYNGVVSFKDATGFAIEKNTIITNKHVSKDYKVGDRITAHPNGDKGNGGIYKIKNISDYPGNEDISVMNVEENAVERGANGYNFNENVQAFNFAKDAKVDDKIKVIGYPLPAQNTFKQFESTGTVKSIKDNNLNFDAYIEPGNSGSPVLNLNNEVVGVVYGGIGKIGSEYNGAVYFTPQIKEFIQKHIEQ

SEQ ID NO: 30641 - protein, 807 aa, Staphylococcus aureus
  strain bovine RF122 / ET3-1
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 30642 - protein, 331 aa, Staphylococcus aureus
  strain bovine RF122 / ET3-1
MSNQFKSEEERRQWEQFQAFQNQQNQQHQQYGQKKSKKGWFWGCGGCLVLFILIIIGISACTAGVTGNLGGNSSKEANKTHKIGETVKNDDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNSSKSDKSSVEKSESNEETAPVEPMPQSKPTTSEASPSQNIHNEDSMYDASTE

SEQ ID NO: 30643 - protein, 251 aa, Staphylococcus aureus; identical to SEQ ID NO: 30162
  strain bovine RF122 / ET3-1

SEQ ID NO: 30644 - protein, 205 aa, Staphylococcus aureus
  strain bovine RF122 / ET3-1
MKKLSTVIIILILEIVFHNINYANALPDPKIDELNKVSDYKSNKGTMGNVMNLYMSPPVEGRGVINSRQFLSHDLNFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQKLDYKARHWLTKEKSYTSLMVLHLNLNI

SEQ ID NO: 30645 - protein, 311 aa, Staphylococcus aureus
  strain bovine RF122 / ET3-1
MFKKKMLAATLSVGLIAPLASPIQESRANTNIENIGDGAEVIKRTEGVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30646 - protein, 327 aa, Staphylococcus aureus
  strain bovine RF122 / ET3-1
MKMKKLVKSSVASSIALLLLSNTVDAAQHITPVSEKKVDDKITLYKTTATSDNDKLNISQILTFNFIKDKSYDKDTLVLKAAGNINSGYKKPNPRDYDYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 30647 - protein, 261 aa, Staphylococcus aureus; identical to SEQ ID NO: 30499
  strain bovine RF122 / ET3-1

SEQ ID NO: 30648 - protein, 254 aa, Staphylococcus aureus
  strain bovine RF122 / ET3-1
MLNVLLLIIYLIAICSVNNAYANEENPKIEDLCKKSSVDDIALHNIDKDYMTNRFTINESPVLTTEKFLDFDLLFKNFTWLDGKSAEFKDLKVEFSSSEISKEYFGKTVDIYGVYYKAHCHGEHQVKTACTYGGVTPHENNKLNEPKEIGVAVYKDNVNVNTFIVTTDKKKVTAQELDIKVRTKLNNVYKLYDRMTSDVQKGYIKFHSHSEHKESFYYDLFYIKGNLPDQCLQIYNDNKTIDSSDYHIDVYLFT

SEQ ID NO: 30649 - protein, 242 aa, Staphylococcus aureus
  strain bovine RF122 / ET3-1
MKKFKYSFIVVFILFFNVYDLSYAQGDIGVGNLRNFYTKYDYIDLKGVTDKNLPTANQLEFSTGPNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNKGKVLFHLNDEKSFSYDLFYTGDGVPVSFLKIYEDNKIIESEKFHLDVEISYVDSN

SEQ ID NO: 30650 - protein, 351 aa, Staphylococcus aureus
  strain bovine RF122 / ET3-1
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQKYDTIAIGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 30651 - protein, 338 aa, Staphylococcus aureus
  strain bovine RF122 / ET3-1
MIKQLYKNITICSLTISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLPGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 30652 - protein, 330 aa, Staphylococcus aureus
  strain bovine RF122 / ET3-1
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFIYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30653 - protein, 360 aa, Staphylococcus aureus
  strain bovine RF122 / ET3-1
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGAKRVIDLKAGIYTADLINTSEIKAININVDTKKQVEDKKKDKANYQVPYTITVNGTSQNILSNLTFNKNQNISYKDLEGKVKSVLESNRGIIDVDLRLSKQAKYTVNFKNGTKKVIDLKAGIYTANLINSSDIKSIDINVDTKKHVENKAKRNYQVPYSINLNGTSTPILSKLKLSQKELISYKYLNDKVKSVLKSERGISDLDLKFAKQAKYTVHFKNGKKQVVNLKSDIFTPNLFSAKDIKKH

SEQ ID NO: 30654 - protein, 231 aa, Staphylococcus aureus
  strain bovine RF122 / ET3-1
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSADQANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 30655 - protein, 259 aa, Staphylococcus aureus
  strain bovine RF122 / ET3-1
MRKIFILITLLFGYSSYSLLEARAETQNDPNISELNKSSQYTGSWHNIWYLYNSDPVNAKKIKLSDKFLSHDFIVPINNPGHYDYVKTELKDSTMASSFDGKEVDIFGVNYFDQCYFSNENIQCDSNQGGGSKKTCMYGGITLNENNTNNRIQPIVVKVYENDSVTLSFDINIDKETVTIQELDYKVRNKLISKINLYHLGGTSYETGYIKFIENGNRYYWYDMMPDPGFTQSKYLMIYRGNETVESAKTEIEVHLTKK

SEQ ID NO: 30656 - protein, 241 aa, Staphylococcus aureus
  strain bovine RF122 / ET3-1
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNNQMMSPKANMHSSKHQINQSNKKVLPVAGESMTSSILTASIAALLLVSGLFLAFRRRSTNK

SEQ ID NO: 30657 - protein, 652 aa, Staphylococcus aureus
  strain bovine RF122 / ET3-1
MLRGQEERKYSIRKYSIGVVSVLAATMFIVSSHEAQASEKTLTSNAAAQKETLNQPGEQGNAITSHQMQSGKQLDDMHKENSKSGTVTEGKDTLQSSKHQSTQNSKIIRTQNDNQVKQDSERQGSKQSHQNNATNKTERQNDQIQNTHHAERNGPQSTTSQSNDVDKSQPSIPAQKVIPNHDKAAPTSTTPPSNDKTAPKSTKEQDATTDKHPNQQDTHQPAHQIIDAKQDDNVHQSDQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGSKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDCLVLKTF

SEQ ID NO: 30658 - protein, 203 aa, Staphylococcus aureus
  strain bovine RF122 / ET3-1
MFKKYDSKNSIVLKSILSLGIIYGGTFGIYPKADASTQNSSSVQDKQFQKVEEVPNNSEKALVKKLYDRYSQNTINGKSNKARNWVYSERPLNENQVRIHLEGTYRVADRVYTPKRNITLNKEVVTLKELDHIIRFAHISYGLYMGEHLPKGNIVINTKNGGKYTLESHKELQKNRENVEINTDDIKNVTFELVKSVNDIEQV

SEQ ID NO: 30659 - protein, 231 aa, Staphylococcus aureus
  strain bovine RF122 / ET3-1
MKMKNIAKISLLLGILATGVNTTTEKPVHAEKKPIVISENSKKLKAYYTQPSIEYKNVTGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRVEIKVRKA

SEQ ID NO: 30660 - protein, 226 aa, Staphylococcus aureus
  strain bovine RF122 / ET3-1
MKFKAIAKASLALGMLATGVITSNVQSVQAKTEVKQQSESELKHYYNKPFFERKNVTGYKYTENGKDYMEVATDHQYYQISLLGPDKDKFKEGNNPGLDIFVVREGDSRQAANYSIGGVTKTNSQPFIDYIHTPILEIKKGKEEPQSSLYQIYKEDISLKELDFKLRKQLISQSGLYSNGLKQGQITITMKDGKSHTIDLSQKLEKERMGESIDGREIQKILVEIK

SEQ ID NO: 30661 - protein, 240 aa, Staphylococcus aureus; identical to SEQ ID NO: 30548
  strain bovine RF122 / ET3-1

SEQ ID NO: 30662 - protein, 271 aa, Staphylococcus aureus; identical to SEQ ID NO: 30547
  strain bovine RF122 / ET3-1

SEQ ID NO: 30663 - protein, 234 aa, Staphylococcus aureus; identical to SEQ ID NO: 30546
  strain bovine RF122 / ET3-1

SEQ ID NO: 30664 - protein, 348 aa, Staphylococcus aureus
  strain bovine RF122 / ET3-1
MKMRTIAKTSLALGLLTTGAITVTTQSVKAEKVPMLKAERLAMINITTGANTATTQAANTRQERTPKLEKAPNTNEEKTSASKIEKISQPKQEAQKSLNISATPAPKQEQSQTTTESTTPKTKVTTPPSINTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSITKKDNQGMISRDVSEYMITKEEISLKELDFKLRKQLIEKHNLYGNMGSGTIVTKMKNGGKYTFELHKKLQEHRMADVIEGTNIDKIEVNIK

SEQ ID NO: 30665 - protein, 231 aa, Staphylococcus aureus
  strain bovine RF122 / ET3-1
MKLKNIAKASLALGILTTGMITTTAQPVKADENSSRLAVTSKDTQELKKYYSGTGYNFQNVSGYREGNKMNIIDGPQLNVVTLLGTDKERFKDDEDYEGLDVFVVREGSGKHADNISIGGITKTNKNQYKDPVQNVNLLTSKSNGQNTTSVTSEYYSINKEEISLKELDFKLRKQLIDKHDLYKTEPKDSKIRITMKDGGFYTFELNKKLQTHRMGDVIDGRNIEKIEVNL

SEQ ID NO: 30666 - protein, 219 aa, Staphylococcus aureus
  strain bovine RF122 / ET3-1
MKFTALAKATLALGILTTGTLTTEAHSSHAKQNQESVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGGSHRKQTN

SEQ ID NO: 30667 - protein, 232 aa, Staphylococcus aureus
  strain bovine RF122 / ET3-1
MKFTALAKATLALGILTTGVFTAESKAVHAKVELDETQCKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKKIKNIEVNLN

SEQ ID NO: 30668 - protein, 232 aa, Staphylococcus aureus
  strain bovine RF122 / ET3-1
MKFTAIAKAIFVLGILTTSVMITENQSVNAKGKYEKMNRLYDTNKLHQYYSGPSYELTNVSGQSQDYYETNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFESMADVISSEQIKNIEVNLK

SEQ ID NO: 30669 - protein, 231 aa, Staphylococcus aureus
  strain bovine RF122 / ET3-1
MKLKTLAKATLALGLLTTGVITSEGQAVQAKEKQERVQHLYDIKDLHRYYSSESFEFSNISGKVENYNGSNVVRFNQKGQNHQLFLLGKDKEEYKEGIEGKDVFVVKELIDPNGRLSTVGGVTKKNNQSSETNTPLVVNKVYGGDLHASIDSFSINKEEVSLKELDFKIRKQLVEKYGLYQGTSKYGKITIILNDGKKEVIDLGDKLQFERMGDVLNSKDINKIEVTLKQI

SEQ ID NO: 30670 - protein, 216 aa, Staphylococcus aureus
  strain bovine RF122 / ET3-1
MKMTAIAKASLALGILATGTITSTHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPKFVIKKEVDAGVYTHVKRHYIYKEEISLKELDFKLRQYLIQNFDLYKKFPKDSKIKVIMKDGGYYTFELNKNYKQIA

SEQ ID NO: 30671 - protein, 335 aa, Staphylococcus aureus
  strain bovine RF122 / ET3-1
MQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNAASNSSRPSTNSGGGSYYTVQAGDSLSLIASKYGTTYQKIMSLNGLNNFFIYPGQKLKVTGNATSSNSASATTTNRGYNTPVFSHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 30672 - protein, 268 aa, Staphylococcus aureus
  strain bovine RF122 / ET3-1
MKMNKLVKSSVATSMALLLLSSTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSIAYAGQNFIAQHQMPLLSRSNFNPEFLSVLSHRQDGAKNLKLQ

SEQ ID NO: 30673 - protein, 315 aa, Staphylococcus aureus
  strain bovine RF122 / ET3-1
MLKNKILATTLSVSLLAPLANPLLENAKAANDTEDIGKGSDIEIIKRTEDKTSNKWGVTQNIQFDFVKDKKYNKNALILKMQGFISSRTTYYNYKKTNHIKAMRWPFQYNIGLKTNDKYVSLINYLPKNKIESTNVSQTLGYNIGGNFQSAPSLGGNGSFSYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 30674 - protein, 309 aa, Staphylococcus aureus
  strain bovine RF122 / ET3-1
MIKNKILTATLAVGLMAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPATRDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 30675 - protein, 436 aa, Staphylococcus aureus
  strain bovine RF122 / ET3-1
MKNKYISKLLVGAATITLATMISNGEAKASENTQQTSTKHQTTQNNYITDQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNEKDSIENRRLAQREVNKAPMDVKEHLHKQLDALVAQKDAEKKVAPKVEAPQIQSPQIEKPKAESPKVEVPQIQSPKVEVPQSKLLGYYQSLKDSFNYGYKYLTDTYKSYKEKYDTAKYYTDKYFKYKGTIDKTVQSVFGNGYKSYIQPLKVEDQKNYVSKSYAQVRNYVTETLNTGKVLYAFYQNPKLVNAAITTAETATSIKNIFSSFTSFFK

SEQ ID NO: 30676 - protein, 990 aa, Staphylococcus aureus
  strain bovine RF122 / ET3-1
MKNNLRYGIRKHKLGAASVFLGTMIVVGMGQDKEAATSEQKTTTVEENGNSATDNKVSETQTTTTNVNTIDETQSYSATATEQPSNATQVITEEAPKAVQAPQTAQPANLETVKEEVVKEEEKPQVKETTQSQDNSGDQRQVDLTPKKATQNQAAETQVEVAQPRTVSESKPRVTRSADVAEAKEASDVTEVKGTDVTSKVTVTESSIEGHNNTNKVEPHAGQRAVLKYKLKFEDGLHQGDYFDFTLSNNVNTHGVSTARKVPEIKNGSVVMATGKILEDGKIRYTFTNDVEHKVEVTANLEINLFIDPKTFQSNGEEKVTSSLNGSKTEKNLQIEYKNGVGTYYANVNGSIETFDKEKNKFTHVAYVKPLNQFKLGTVTVSGTVTQGSNPNGEKPTVKIYEVTNDGKDLPQSVYLDASDKNKYKDVTNEMQSKLTVQENGNYTLNLDTLDKSYVIHYSGEYLNGTNEVNFRTQMFGYPEQRYGYYYNSYQLTWDNGLVLYSNKADGNGKNGQIIQNNDFEYKEDTLTETVTGQYDEKQIIETEENQDNTPLDIDYHTAIDGEGGYADGYIETIEETDSSAIDIDYHTAVDSEAGHVGGYTESSEESNPIDFEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAEEEPKKPSKPVEQGKVVTPVIEINEKVKAVAPTKQKQSKKSELPETGGEESTNKGMLFGGLFSILGLALLRRNKKNHKA

SEQ ID NO: 30677 - protein, 221 aa, Staphylococcus aureus
  strain bovine RF122 / ET3-1
MKAKLWFLLTTLAFLIAVTESIGIAEVKAKTTGLITENSNDSLKEHYAQKFEVYTNKEVTGVGENYIDTKVDTYNVRTVLYNTDYLKQFKNQDKVNIWGTLYENQQSKVYRGTVVKYDPISKVTNLSYRMNLFVNGHQTKVNPDSLLEVKNKQISLKETDFRIRKYLLEKEHLYSNYNSGELIIEMKNGARHKIDLGDILSDSQEKTFDFDNISHIDIYMK

SEQ ID NO: 30678 - protein, 233 aa, Staphylococcus aureus
  strain bovine RF122 / ET3-1
MKKTIMASSLAVALGVTGYAASTGHEAHAAEMNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLSAWGF

SEQ ID NO: 30679 - protein, 861 aa, Staphylococcus aureus
  strain bovine RF122 / ET3-1
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQSLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGIYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPKDPTPGPPVDPEPEPEPTPDPEPSPDPDPEPTPDPEPSPEPDPDSDSDSDSGSDSDSGSDSDSDSDSNSDSDSDSDSDSDSDSDSDSNSDSDSDSDSDSDSDSDSDSDSDLDSDSESDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSESDSDSDSDSDIDSDSDSDSDSRVTPPNNEQKAPSNPKGEVNHSNKVSKQHKTDALPETGDKSENTNATLFGAMMALLGSLLLFRKRKQDHKEKA

SEQ ID NO: 30680 - protein, 895 aa, Staphylococcus aureus
  strain bovine RF122 / ET3-1
MASVLVGTLIGFGLLSSKEADASENSVTQSDSASIEIKSSDSSSVNVAPKTDNTNVSDTKTTSNTNNGETSVAQNPAQQETTQSASTNATTEETPVTGETTTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSFGNVIYTFTDYVNTKENVTANITMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNVADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPENSDSDPGSDSGSDSNSDSGSDSGSDSTSDSDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSDSASDSDSDSDSDSDSDSDSDSDSDSDSDSDSDSDSDSDSDSDSDSDSDSNSDSDSDSASDSASDSDSGSASDSDSDSDSASDSDTDSDSDSDNASDSDSDSDSASDSDSDSTSDTGSDNDSDSESDSNSDSDSGSNNNVVLPNSPKNGTNASNKNEAKDSKEPLPDTGSEGEANTSLIWGLLASLGSLLLFRRKKENKDKK

SEQ ID NO: 30681 - protein, 322 aa, Staphylococcus aureus; identical to SEQ ID NO: 30454
  strain bovine RF122 / ET3-1

SEQ ID NO: 30682 - protein, 308 aa, Staphylococcus aureus; identical to SEQ ID NO: 30455
  strain bovine RF122 / ET3-1

SEQ ID NO: 30683 - protein, 227 aa, Staphylococcus aureus
  strain bovine RF122 / ET3-1
MKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKVDGKIDVYIDEKVNGKPFKYDHHYNITYKFNGPTDVAGANAPGKDDKNSASGSDKGSDGATTGQSESNSSNKDKVENPQTNAGTPAYIYAIPVASLALLIAITLFVRKKSKGNVE

SEQ ID NO: 30684 - protein, 350 aa, Staphylococcus aureus
  strain bovine RF122 / ET3-1
MTKHYLNSKYQSEQRSSAMKKITMGTASIILGSLVYIGADSQQVNAATEATNANNNQSAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQTKTPTEQTKPVQPKVEKVKPTVTTTSKVEDNHSTKVVSTDTTKDQTKTQTAHTVKTAQTAQEQNKVQTPVKDVASAKSESNNQAVSDNKSQQTNKVTKQNESPKQASKAKELPKTGLTSVDNFISTVAFATLALLGSLSLLLFKRKESK

SEQ ID NO: 30685 - protein, 629 aa, Staphylococcus aureus
  strain bovine RF122 / ET3-1
MNKQQKEFKSFYSIRKSSLGVASVAISTLLLLMSNGEAQAAEETGGTNTEAQPKTEAVASPSTTTEKAPEAKSVANAVSVSNKEVEAPTSETKEVKPAAKSDNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPATPSKPTTPPVEKESQKQDSQKDDNKQSPSVEKENDASSESGKDKTPATKPAKGEVESSSTTPTKVVSTTQNAAKPTTASSETTKDVVQTSAGSSEAKDSAPLQKANIKNTNDGHTQSENNKNTQENKAKSLPQTGEESNKDMTLPLMSLLALSSIIAFVLPRKRKN

SEQ ID NO: 30686 - protein, 238 aa, Staphylococcus aureus
  strain bovine RF122 / ET3-1
MNKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPILTLKEIDFRAREALIKNKILYNENRNKGKLKITGGGNNYTIDLSKRLHSDLANVYVKNPNKITVDVLFD

SEQ ID NO: 30687 - protein, 319 aa, Staphylococcus aureus; identical to SEQ ID NO: 30495
  strain bovine RF122 / ET3-1

SEQ ID NO: 30688 - protein, 165 aa, Staphylococcus aureus
  strain bovine RF122 / ET3-1
MKNKLIAKSLLTIAVIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFKYKVKKMVLQERIDNVLKQGLVK

SEQ ID NO: 30689 - protein, 133 aa, Staphylococcus aureus
  strain bovine RF122 / ET3-1
MKKNITKTIIASTVIAAGLLTQTNDAKAFFSYEGKGLEIAKNLADQAKKDDERIDKLMKESDKNQTPYKAETVNDLYLIVKKLSQGDVKKAVVRIKDGGPRDYYTFDLTRPLEENRKNIKVVKNGEIDSIYWD

SEQ ID NO: 30690 - protein, 109 aa, Staphylococcus aureus
  strain bovine RF122 / ET3-1
MKKNFIGKSILGIAAISLTVSTFAGESHAQTKNAETVKKYNEYQTNFKKQVNKKVVDAQKAVNLFKRTRTVATHRKAQRAVNLIHFQHSYEKKKLQRQIDLVLKYNTLK

SEQ ID NO: 30691 - protein, 241 aa, Staphylococcus aureus
  strain bovine RF122 / ET3-1
MNNNITKKIILSTTLLLLGTASTQFPNTPISSSTEAKAYYINQNETNVNELTKYYSQQHLTFSNKTLWQKDNGTIHATLLQFSWYSHIQVYGPESWGNIIQLRNKNVDIFGIKDQETIDSFALSQETFTGGVTPAATSNDKHYKLNVTYKDQAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 30692 - protein, 241 aa, Staphylococcus aureus
  strain bovine RF122 / ET3-1
MKKNIMNKLVLSTALLLLGTTSTQLPKTPISFSSEAKAYNISENETNINELIKYYTQPHFSLSNKWLWQKPNGSIHATLQTWVWYSHIQVFGSESWGNINQLRNKYVDIFGTKDEDTVEGYWTYDETFTGGVTPAATSFDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 30693 - protein, 313 aa, Staphylococcus aureus
  strain bovine RF122 / ET3-1
MNYRDKIQKFSIRKYTVGTFSTVIATLVFLGFNTSQAHAAETNQPASVVKQKQQSNNEQTENRESQVQNSQNSINGQSLSATHENEQPNISQANLVDQKVAQSSTTNDEQPASQNVNTKKDSATAATTQPDKEESKHKQNESQSANKNGNDNRAAHVENHEANVVTASDLSDNGNVQHDRNELQAFFDANYHDYRFIDRENAVSGTFNYVKGIFDKINTLLGSNDPINNKDLQLAYKELEQAVALIRTMPQRQQTSRRSSRIQTRSVEARAAEPRSVSDYQNANSSYYVENANDGSGGSVAKLKNKCLTLCLK

SEQ ID NO: 30694 - protein, 1977 aa, Staphylococcus aureus
  strain bovine RF122 / ET3-1
MNLFRQQKFSIRKFNVGIFSALIATVTFISTNPTTASAAEQNQPAQNQPAQPADVNTQPNANAGAQANPTAQPAAPANQGQPAAQPANQGGQANPAGGAAQPNTQPAGQGNQADPNNAAQAQPGNQAAPANQAGQGNNQATPNNNATPANQTQPANAPAAAQPAAPVAANAQTQDPNASNTREGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEVGNNGNFGASLKADQFKYEVTLPQGVTYVNDSLTTTFPNGNEDSTVLKNMTVNYDQTANTNSDVTTAKDNGIAAINQVQAVTTKKSDAKAEIAQKASERKTAIEAMNDSTTEEQQAAKDKVDQAVVTANTDIDNAAANTDVDNAKTTNEATIAAITPDANVKPTAKQAIADKVQAQETAIDANNGATTEEKATAKQQVQTEKATADTAIDGAHSNAEVEAAKNAEIAKIEAIQPATTTKDDAKQAITTKANERKTAIAQTQDITAEEIAAANADVDNAVTQANSNIEAANSQNDVDQAKTTGETSIDQVTPTVNKKATARNEITTILNNKLQEIQATPDVTDEEKQTADAEANTENGKANQAISAATTNAQVDEAKANAEAAINAVTSKVVKKQAAKDEIDQLQVAQTSVINNDQNATTEEKEAAIQQLATAVTDAKNNITAATDDNGVDTAKDAGKNSIQSTQPATAVKSNAKNEVDQAVTTQNQAIDNTTGATTEEKNAAKDLVLKVKEKAYQDILNAQTTNDVTQIKDQAVADVQGITADTTIKDVARDELATKANEQKALIAQTADATTEEKEQENQQVDAQLTQGNQNIENAQSIDDVNTAKDNAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAVLNQAKTNVDQSSTNEYVDNAVKEGKAKINAVKTFSEYKKDALAKIADAYNAKVNEEDNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNSDVDDALTQGKAAIDTIQVDATVKPKANQAIEAKAEDTKESIDHSDQLTAEEKTEALAMIKQITDQAKKGITDATTTAEVEKAKAQGLEAFDNIQIDSTEKQKAIEELEAALDQIEAGVNVDADATTEEKEAFTNALEDILSKATEDISDQTTNAEIATIKNSALEQLKAQRINPVVKKNTLEAIREVVNKQIEIIKNADADASAKEIARTDLGRYFDRFADKLDKTQTNTEVAELQNVTIPAIEAIVPQNDPNANDTNNGTDNNDATANSNANATPENTGQPNVTESTDNANADTSSTTTNNQNDTTTGETTATSANSSATNDANNKPTANNNSSVDASTDNSATGNGTTDKPEVESTNNGTTDKPATETDNATPAESTTNNNSTTTATNENVPTGSTATAPTTASTEATSSADSKDNASVNDSKQNAEVNNSAESQSTNGKVAQPKSENKAKAEKDGRDSTNQSMVESTTETLPSADITEPKVSSNTSKDKEESTTNQTDAEQHNSDTNVTSNEVVKSPSKADTDVSNKPSTSASSEAKDKMTSTNVSQTDDTATADTNDTQKSVGSAANNKAKDMQTNDMKAPLATVSKGSNSANQDMLNVTKTKENKANAKSVQQGKVNKPKQQAKTLPDTGMSHNDDLPYAELALGAGMAFLIRRFTKKDHQTEE

SEQ ID NO: 30695 - protein, 141 aa, Staphylococcus aureus
  strain bovine RF122 / ET3-1
MKLKSFVTATLALGLLSTVGAALPSHEASADSNNGYKEMTMDGYHTVPYTISVDGITALHRTYFVFAENKKVLYQEIDSKVKNELASQRGVTTEKINNAQTATYTLTLNDGNKKVVNLKKNDNAKNSIDPSTIKQIQIVVK

SEQ ID NO: 30696 - protein, 809 aa, Staphylococcus aureus
  strain bovine RF122 / ET3-1
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 30697 - protein, 175 aa, Staphylococcus aureus; identical to SEQ ID NO: 30554
  strain bovine RF122 / ET3-1

SEQ ID NO: 30698 - protein, 681 aa, Staphylococcus aureus
  strain bovine RF122 / ET3-1
MMKSQNKYSIRKFSVGASSILIATLLFLSGGQAQATEKQVNMGNSQEDTVTAQSIGDQQTRENANYQRENGVDEQQHTENLTKNLHNDKTISEANHRKTDDLNKDQLKDDKKSSLNNKNIQRDTTKNNNANPSDVNQGLEQAINDGKQSKVASQQQSKQADNSQDSNANNNLPSQSRTKEALPLNKSNQTSQREIVNKTEIEKVEPQQNNQANDKITNYNFNNEQEVKPQKDEKTLSVSDLKNNQKSPVEPTKDNDKKNGLNLLKSSAVATLPNKGTKELTAKAKGDQMNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 30699 - protein, 338 aa, Staphylococcus aureus
  strain COL
MIKQLCKNITICTLALSTTFTVLPATSFAKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 30700 - protein, 680 aa, Staphylococcus aureus
  strain COL
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 30701 - protein, 292 aa, Staphylococcus aureus
  strain COL
MKYRKFIILVLSILIILPVSTLDGHHIANADDDSPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDLHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKDET

SEQ ID NO: 30702 - protein, 2261 aa, Staphylococcus aureus
  strain COL
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 30703 - protein, 175 aa, Staphylococcus aureus; identical to SEQ ID NO: 30554
  strain COL

SEQ ID NO: 30704 - protein, 913 aa, Staphylococcus aureus
  strain COL
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 30705 - protein, 233 aa, Staphylococcus aureus; identical to SEQ ID NO: 30428
  strain COL

SEQ ID NO: 30706 - protein, 255 aa, Staphylococcus aureus
  strain COL
MKKIVTATIATAGLATIAFAGHDAQAAEQNNNGYNSNDAQSYSYTYTIDAQGNYHYTWTGNWNPSQLTQNNTYYYNNYNTYSYNNASYNNYYNHSYQYNNYTNNSQTATNNYYTGGSGASYSTTSNNVHVTTTAAPSSNGRSISNGYASGSNLYTSGQCTYYVFDRVGGKIGSTWGNASNWANAAASSGYTVNNTPKVGAIMQTTQGYYGHVAYVEGVNSNGSVRVSEMNYGHGAGVVTSRTISANQAGSYNFIH

SEQ ID NO: 30707 - protein, 1018 aa, Staphylococcus aureus
  strain COL
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 30708 - protein, 940 aa, Staphylococcus aureus; identical to SEQ ID NO: 30465
  strain COL

SEQ ID NO: 30709 - protein, 1243 aa, Staphylococcus aureus
  strain COL
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 30710 - protein, 325 aa, Staphylococcus aureus; identical to SEQ ID NO: 30407
  strain COL

SEQ ID NO: 30711 - protein, 315 aa, Staphylococcus aureus
  strain COL
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQILGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 30712 - protein, 309 aa, Staphylococcus aureus; identical to SEQ ID NO: 30406
  strain COL

SEQ ID NO: 30713 - protein, 436 aa, Staphylococcus aureus [sequence omitted]

SEQ ID NO: 30714 - protein, 267 aa, Staphylococcus aureus
  strain COL
MKKIATATIATAGFATIAIASGNQAHASEQDNYGYNPNDPTSYSYTYTIDAQGNYHYTWKGNWHPSQLNQDNGYYSYYYYNGYNNYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNSNGSVRVSEMNYGYGPGVVTSRTISASQAAGYNFIH

SEQ ID NO: 30715 - protein, 141 aa, Staphylococcus aureus
  strain COL
MKLKSFVTATLALGLLSTVGAALPSHEASADSNNGYKEMTVDGYHTVPYTISVDGITALHRTYFIFPENKNVLYQEIDSKVKNELASQRGVTTEKINNAQTATYTLTLNDGNKKVVNLKKNDDAKNSIDPSTIKQIQIVVK

SEQ ID NO: 30716 - protein, 807 aa, Staphylococcus aureus
  strain COL
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 30717 - protein, 2478 aa, Staphylococcus aureus; identical to SEQ ID NO: 30559
  strain COL

SEQ ID NO: 30718 - protein, 231 aa, Staphylococcus aureus
  strain COL
MKKTLLASSLAVGLGIVAGNAGHEAHASEADLNKASLAQMAQSNDQTLNQKPIEAGAYNYTFDYEGFTYHFESDGTHFAWNYHATGTNGADMSAQAPTTNNVAPSAVQANQVQSQEVEAPQNAQTQQPQASTSNNSQVTATPTESKSSEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 30719 - protein, 26 aa, Staphylococcus aureus
  strain COL
MAQDIISTIGDLVKWIIDTVNKFTKK

SEQ ID NO: 30720 - protein, 351 aa, Staphylococcus aureus
  strain COL
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 30721 - protein, 330 aa, Staphylococcus aureus; identical to SEQ ID NO: 30381
  strain COL

SEQ ID NO: 30722 - protein, 684 aa, Staphylococcus aureus
  strain COL
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQVEDKKKDKANYQVPYTITVNGTSQNILSNLTFNKNQNISYKDLEDKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSDLKFTGDPRVGYKDISKKVKSVLKHDRGIGERELKYAKKATYTVHFKNGTKKVININSNISQLNLLYVQDIKKIDIDVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKNNKSNNVKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 30723 - protein, 388 aa, Staphylococcus aureus
  strain COL
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTISPKITKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYINKLENFKIRETQGNNGWCAGYTMSELLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNSWDNGFMTQDAKNNVIPVSNGDHYRWYSSIYGY

SEQ ID NO: 30724 - protein, 311 aa, Staphylococcus aureus; identical to SEQ ID NO: 30617
  strain COL

SEQ ID NO: 30725 - protein, 327 aa, Staphylococcus aureus; identical to SEQ ID NO: 30538
  strain COL

SEQ ID NO: 30726 - protein, 238 aa, Staphylococcus aureus
  strain COL
MNKNVMVKGLTALTILTILTSLGFAENISNQPHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHELIGILYAGSGKDESEKNFGVYFTPQLKEFIQNNIEK

SEQ ID NO: 30727 - protein, 240 aa, Staphylococcus aureus
  strain COL
MNKNVVIKSLAALTILTSVTGIGTTLVEEVQQTAKAENNVTKVKDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 30728 - protein, 239 aa, Staphylococcus aureus
  strain COL
MNKNIVIKSMAALAILTSVTGINAAVVEETQQIANAEKNVTQVKDTNIFPYNGVVSFKDATGFVIGKNTIITNKHVSKDYKVGDRITAHPNGDKGNGGIYKIKSISDYPGDEDISVMNIEEQAVERGPKGFNFNENVQAFNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 30729 - protein, 239 aa, Staphylococcus aureus
  strain COL
MNKNIIIKSIAALTILTSITGVGTTVVDGIQQTAKAENSVKLITNTNVAPYSGVTWMGAGTGFVVGNQTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVTSDAVVQPGSSGSPILNSKREAIGVMYASDKPTGESTRSFAVYFSPEIKKFIADNLDK

SEQ ID NO: 30730 - protein, 238 aa, Staphylococcus aureus
  strain COL
MNKNIIIKSIAALTILTSVTGVGTTVVEGIQQTAKAEHNVKLIKNTNVAPYNGVVSIGSGTGFIVGKNTIVTNKHVVAGMEIGAHIIAHPNGEYNNGGFYKVKKIVRYSGQEDIAILHVEDKAVHPKNRNFKDYTGILKIASEAKENERISIVGYPEPYINKFQMYESTGKVLSVKGNMIITDAFVEPGNSGSAVFNSKYEVVGVHFGGNGPGNKSTKGYGVYFSPEIKKFIADNTDK

SEQ ID NO: 30731 - protein, 239 aa, Staphylococcus aureus
  strain COL
MNKNIIIKSIAALTILTSITGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 30732 - protein, 331 aa, Staphylococcus aureus
  strain COL
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMPHSKPTTSEAPPSQNIHNEDSMYDASTE

SEQ ID NO: 30733 - protein, 2186 aa, Staphylococcus aureus
  strain COL
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGEPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30734 - protein, 895 aa, Staphylococcus aureus
  strain COL
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 30735 - protein, 291 aa, Staphylococcus aureus; identical to SEQ ID NO: 30390
  strain COL

SEQ ID NO: 30736 - protein, 234 aa, Staphylococcus aureus
  strain COL
MLEGIFTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQTEIELTAVKTKKKIVTIQELEVQLRNYLNEKYKLYEQGGDIVKGYVKYYNDDEQNVEYDFYNLNGEYGREVLKMYADNKTINSDKLHLDIYLFKS

SEQ ID NO: 30737 - protein, 383 aa, Staphylococcus aureus
  strain COL
MFLYYCKECFIMNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 30738 - protein, 241 aa, Staphylococcus aureus
  strain COL
MKKNIMNKLVLSTALLLLETTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEIEVILEKSN

SEQ ID NO: 30739 - protein, 241 aa, Staphylococcus aureus
  strain COL
MNNNITKKIILSTTLLLLGTASTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 30740 - protein, 238 aa, Staphylococcus aureus
  strain COL
MSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 30741 - protein, 319 aa, Staphylococcus aureus
  strain COL
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 30742 - protein, 165 aa, Staphylococcus aureus
  strain COL
MKNKLIAKSLLTLAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVK

SEQ ID NO: 30743 - protein, 133 aa, Staphylococcus aureus
  strain COL
MKKNITKTIIASTVIAAGLLTQTNDAKAFFSYEWKGLEIAKNLADQAKKDDERIDKLMKESDKNLTPYKAETVNDLYLIVKKLSQGDVKKAVVRIKDGGPRDYYTFDLTRPLEENRKNIKVVKNGEIDSITWY

SEQ ID NO: 30744 - protein, 109 aa, Staphylococcus aureus
  strain COL
MKKNFIGKSILSIAAISLTVSTFAGESHAQTKNVEAAKKYDQYQTNFKKQVNKKVVDAQKAVNFFKRTRTVATHRKAQRAVNLIHFQHSYEKKKLQRQIDLVLKYNTLK

SEQ ID NO: 30745 - protein, 227 aa, Staphylococcus aureus
  strain COL
MKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYTIPVASLALLIAITLFVRKKSKGNVE

SEQ ID NO: 30746 - protein, 350 aa, Staphylococcus aureus
  strain COL
MTKHYLNSKYQSEQRSSAMKKITMGTASIILGSLVYIGADSQQVNAATEATNAPNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 30747 - protein, 645 aa, Staphylococcus aureus
  strain COL
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 30748 - protein, 1256 aa, Staphylococcus aureus
  strain COL
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMALNQVAQIQAGLQYKPQVQRVPGKWTGANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 30749 - protein, 336 aa, Staphylococcus aureus
  strain COL
MKGKFLKVSSLFVATLTTATLVSSPAANALSSKAMDNHPQQTQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDEPNNPDNPNNPDNPDNGDTNNSDNPDAA

SEQ ID NO: 30750 - protein, 393 aa, Staphylococcus aureus
  strain COL
MNSSCKSRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLPGNVKEKESAKTVSAKLKQELKNTVTPTKVEENEAIQEDQVQYENTLKNFKIREQQFDNSWCAGFSMAALLNATKNTDTYNAHDIMRTLYPEVSEQDLPNCATFPNQMIEYGKSQGRDIHYQEGVPSYEQVDQLTKDNVGIMILAQSVSQNPNDPHLGHALAVVGNAKINDQEKLIYWNPWDTELSIQDADSSLLHLSFNRDYNWYGSMIGY

SEQ ID NO: 30751 - protein, 266 aa, Staphylococcus aureus; identical to SEQ ID NO: 30401
  strain COL

SEQ ID NO: 30752 - protein, 242 aa, Staphylococcus aureus; identical to SEQ ID NO: 30537
  strain COL

SEQ ID NO: 30753 - protein, 242 aa, Staphylococcus aureus; identical to SEQ ID NO: 30536
  strain COL

SEQ ID NO: 30754 - protein, 228 aa, Staphylococcus aureus
  strain COL
MTEYLLSAGICMAIVSILLIGMAISNVSKGQYAKRFFYFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQLLRKSEAQAKKEKLNIWSEDNADSGQ

SEQ ID NO: 30755 - protein, 933 aa, Staphylococcus aureus
  strain COL
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 30756 - protein, 434 aa, Staphylococcus aureus [sequence omitted]

SEQ ID NO: 30757 - protein, 646 aa, Staphylococcus aureus
  strain COL
MSSQKKKISLFAFFLLTVITITLKTYFSYYVDFSLGVKGLVQNLILLMNPYSLVALVLSVFLFFKGKKAFWFMFIGGFLLTFLLYANVVYFRFFSDFLTFSTLNQVGNVESMGGAVSASFKWYDFVYFIDTLVYLFILIFKTKWLDTKAFSKKFVPVVMAASVALFFLNLAFAETDRPELLTRTFDHKYLVKYLGPYNFTVYDGVKTIENNQQKALASEDDLTKVLNYTKQRQTEPNPEYYGVAKKKNIIKIHLESFQTFLINKKVNGKEVTPFLNKLSSGKEQFTYFPNFFHQTGQGKTSDSEFTMDNSLYGLPQGSAFSLKGDNTYQSLPAILDQKQGYKSDVMHGDYKTFWNRDQVYKHFGIDKFYDATYYDMSDKNVVNLGLKDKIFFKDSANYQAKMKSPFYSHLITLTNHYPFTLDEKDATIEKSNTGDATVDGYIQTARYLDEALEEYINDLKKKGLYDNSVIMIYGDHYGISENHNNAMEKLLGEKITPAKFTDLNRTGFWIKIPGKSGGINNEYAGQVDVMPTILHLAGIDTKNYLMFGTDLFSKGHNQVVPFRNGDFITKDYKYVNGKIYSNKNNELITTQPADFEKNKKQVEKDLEMSDNVLNGDLFRFYKNPDFKKVNPSKYKYETGPKANSKK

SEQ ID NO: 30758 - protein, 254 aa, Staphylococcus aureus; identical to SEQ ID NO: 30556
  strain COL

SEQ ID NO: 30759 - protein, 1166 aa, Staphylococcus aureus
  strain COL
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKKNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30760 - protein, 1381 aa, Staphylococcus aureus
  strain COL
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 30761 - protein, 947 aa, Staphylococcus aureus
  strain COL
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 30762 - protein, 334 aa, Staphylococcus aureus; identical to SEQ ID NO: 30414
  strain COL

SEQ ID NO: 30763 - protein, 225 aa, Staphylococcus aureus
  strain COL
MKLKNIAKASLALGILTTGMITTTAQPVKASTLEVRSQATQDLSEYYNRPFFEYTNQSGYKEEGKVTFTPNYQLIDVTLTGNEKQNFGEDISNVDIFVVRENSDRSGNTASIGGITKTNGSNYIDKVKDVNLIITKNIDSVTSTSTSSTYTINKEEISLKELDFKLRKHLIDKHNLYKTEPKDSKIRITMKDGGFYTFELNKKLQTHRMGDVIDGRNIEKIEVNL

SEQ ID NO: 30764 - protein, 227 aa, Staphylococcus aureus; identical to SEQ ID NO: 30585
  strain COL

SEQ ID NO: 30765 - protein, 232 aa, Staphylococcus aureus
  strain COL
MKLTTIAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKQIKNIEVNLN

SEQ ID NO: 30766 - protein, 308 aa, Staphylococcus aureus
  strain COL
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVINSEQIKNIEVNLK

SEQ ID NO: 30767 - protein, 352 aa, Staphylococcus aureus
  strain COL
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMAGTNIDNIEVNIK

SEQ ID NO: 30768 - protein, 231 aa, Staphylococcus aureus
  strain COL
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 30769 - protein, 226 aa, Staphylococcus aureus
  strain COL
MKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTPILEIKKDNEDVLKDFYYISKEDISLKELDYRLRERAIKQHGLYSNGLKQGQITITMNDGTTHTIDLSQKLEKERMGESIDGTKINKILVEMK

SEQ ID NO: 30770 - protein, 203 aa, Staphylococcus aureus
  strain COL
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYTVAGRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 30771 - protein, 690 aa, Staphylococcus aureus; identical to SEQ ID NO: 30419
  strain COL

SEQ ID NO: 30772 - protein, 104 aa, Staphylococcus aureus
  strain COL
MGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 30773 - protein, 130 aa, Staphylococcus aureus
  strain COL
MNFNDIETMVKSKFKDIKKHAEEIAHEIEVRSGYLRKAEQYKRLEFNLSFALDDIESTAKDVQTAKSSANKDSVTVKGKAPNTLYIEKRNLMKQKLEMLGEDIDKNKESLQKAKEIAGEKASEYFNKAMN

SEQ ID NO: 30774 - protein, 97 aa, Staphylococcus aureus
  strain COL
MAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 30775 - protein, 316 aa, Staphylococcus aureus [sequence omitted]

SEQ ID NO: 30776 - protein, 241 aa, Staphylococcus aureus
  strain COL
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 30777 - protein, 508 aa, Staphylococcus aureus
  strain COL
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30778 - protein, 1548 aa, Staphylococcus aureus
  strain COL
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKANTTEQASTEEKADTTEQATTEEAPKAEGTDKVETEEAPKAEETDKATEEAPKTEETDKATTEEAPKAEETDKATEEAPKTEETDKATTEEAPAAEETSKAATEEAPKAEETSKAATEEAPKAEETEKTATEEAPKTEETDKVETEEAPKAEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGTLTAFNTNFNPNTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFAPEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDADSDSDADSDSDADSDSDADSDSDADSDSDSDSDSDSDSDSDADSDSDADSDSDSDSDSDADSDSDADSDSDADSDSDADSDSDSDSDSDADSDSDSDSDSDADSDSDADSDSDADSDSDADSDSDSDSDSDADSDSDSDSDSDSDADSDSDSDSDADSDSDADSDSDADSDSDADSDSDSDSDSDSDSDSDSDSDRDSDADSDSDADSDSDSDSDSDADSDSDSDSDSDADSDSDADSDSDSDADSDSDSDSDSDADSDSDADSDSDADSDSDADSDSDSDSDSDSDSDSDADSDSDADSDSDADRDHNDKTDKPNNKELPDTGNDAQNNGTLFGSLFAALGGLFLVGRRRKNKNNEEK

SEQ ID NO: 30779 - protein, 258 aa, Staphylococcus aureus; identical to SEQ ID NO: 30228
  strain ECT-R 2

SEQ ID NO: 30780 - protein, 268 aa, Staphylococcus aureus; identical to SEQ ID NO: 30398
  strain ECT-R 2

SEQ ID NO: 30781 - protein, 259 aa, Staphylococcus aureus; identical to SEQ ID NO: 30226
  strain ECT-R 2

SEQ ID NO: 30782 - protein, 508 aa, Staphylococcus aureus
  strain ECT-R 2
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30783 - protein, 241 aa, Staphylococcus aureus; identical to SEQ ID NO: 30571
  strain ECT-R 2

SEQ ID NO: 30784 - protein, 62 aa, Staphylococcus aureus; identical to SEQ ID NO: 30610
  strain ECT-R 2

SEQ ID NO: 30785 - protein, 138 aa, Staphylococcus aureus
  strain ECT-R 2
MGEFEVKYLTGFILILLLEGIFTNSASAIEYSDLHHKSKFDSKRLSNAKMSFINPTQLENKNTNDRLLKHDLLFHDMFVNVASKKDFKVEFENEALSKKFINKNIDIYAGSYSYECHGGATNKTQCSYGGVTLSDNNK

SEQ ID NO: 30786 - protein, 291 aa, Staphylococcus aureus; identical to SEQ ID NO: 30390
  strain ECT-R 2

SEQ ID NO: 30787 - protein, 691 aa, Staphylococcus aureus; identical to SEQ ID NO: 30511
  strain ECT-R 2

SEQ ID NO: 30788 - protein, 891 aa, Staphylococcus aureus
  strain ECT-R 2
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 30789 - protein, 2186 aa, Staphylococcus aureus
  strain ECT-R 2
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30790 - protein, 203 aa, Staphylococcus aureus; identical to SEQ ID NO: 30576
  strain ECT-R 2

SEQ ID NO: 30791 - protein, 226 aa, Staphylococcus aureus; identical to SEQ ID NO: 30577
  strain ECT-R 2

SEQ ID NO: 30792 - protein, 231 aa, Staphylococcus aureus; identical to SEQ ID NO: 30578
  strain ECT-R 2

SEQ ID NO: 30793 - protein, 356 aa, Staphylococcus aureus
  strain ECT-R 2
MNMKTIAKTSLALGLLTTGAITVTTQSVKAEKIQSTKVDKVPTLKAERLAMINITAGANSATTQAANTRQERTPKLEKAPNTNEEKTSASKIEKISQPKQEEQKSLNISATPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 30794 - protein, 292 aa, Staphylococcus aureus; identical to SEQ ID NO: 30580
  strain ECT-R 2

SEQ ID NO: 30795 - protein, 234 aa, Staphylococcus aureus; identical to SEQ ID NO: 30581
  strain ECT-R 2

SEQ ID NO: 30796 - protein, 231 aa, Staphylococcus aureus; identical to SEQ ID NO: 30582
  strain ECT-R 2

SEQ ID NO: 30797 - protein, 232 aa, Staphylococcus aureus; identical to SEQ ID NO: 30583
  strain ECT-R 2

SEQ ID NO: 30798 - protein, 232 aa, Staphylococcus aureus; identical to SEQ ID NO: 30584
  strain ECT-R 2

SEQ ID NO: 30799 - protein, 227 aa, Staphylococcus aureus; identical to SEQ ID NO: 30585
  strain ECT-R 2

SEQ ID NO: 30800 - protein, 227 aa, Staphylococcus aureus; identical to SEQ ID NO: 30586
  strain ECT-R 2

SEQ ID NO: 30801 - protein, 331 aa, Staphylococcus aureus; identical to SEQ ID NO: 30615
  strain ECT-R 2

SEQ ID NO: 30802 - protein, 327 aa, Staphylococcus aureus; identical to SEQ ID NO: 30616
  strain ECT-R 2

SEQ ID NO: 30803 - protein, 306 aa, Staphylococcus aureus
  strain ECT-R 2
MLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30804 - protein, 258 aa, Staphylococcus aureus; identical to SEQ ID NO: 30410
  strain ECT-R 2

SEQ ID NO: 30805 - protein, 165 aa, Staphylococcus aureus
  strain ECT-R 2
MKVEFNSSDLANQFKGKNIDIYGLYFGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 30806 - protein, 37 aa, Staphylococcus aureus
  strain ECT-R 2
MPESGKKFYPTKYLLIYNDNKTVESKSINVEVHLTKK

SEQ ID NO: 30807 - protein, 242 aa, Staphylococcus aureus; identical to SEQ ID NO: 30399
  strain ECT-R 2

SEQ ID NO: 30808 - protein, 239 aa, Staphylococcus aureus; identical to SEQ ID NO: 30622
  strain ECT-R 2

SEQ ID NO: 30809 - protein, 254 aa, Staphylococcus aureus
  strain ECT-R 2
MLNVLLLILNLIAICSVNNAYANEEDPKIESLCKKSSVDPIALHNINDDYINNRFTTVKSIVSTTEKFLDFDLLFKSINWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 30810 - protein, 939 aa, Staphylococcus aureus
  strain ECT-R 2
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 30811 - protein, 1337 aa, Staphylococcus aureus
  strain ECT-R 2
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 30812 - protein, 1153 aa, Staphylococcus aureus; identical to SEQ ID NO: 30596
  strain ECT-R 2

SEQ ID NO: 30813 - protein, 96 aa, Staphylococcus aureus
  strain ECT-R 2
MKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 30814 - protein, 242 aa, Staphylococcus aureus
  strain ECT-R 2
MITSPFVNCSEKSEEINGKDLQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 30815 - protein, 274 aa, Staphylococcus aureus
  strain ECT-R 2
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30816 - protein, 338 aa, Staphylococcus aureus; identical to SEQ ID NO: 30627
  strain ECT-R 2

SEQ ID NO: 30817 - protein, 351 aa, Staphylococcus aureus; identical to SEQ ID NO: 30628
  strain ECT-R 2

SEQ ID NO: 30818 - protein, 44 aa, Staphylococcus aureus; identical to SEQ ID NO: 30513
  strain ECT-R 2

SEQ ID NO: 30819 - protein, 231 aa, Staphylococcus aureus; identical to SEQ ID NO: 30630
  strain ECT-R 2

SEQ ID NO: 30820 - protein, 434 aa, Staphylococcus aureus [sequence omitted]

SEQ ID NO: 30821 - protein, 905 aa, Staphylococcus aureus; identical to SEQ ID NO: 30600
  strain ECT-R 2

SEQ ID NO: 30822 - protein, 2481 aa, Staphylococcus aureus
  strain ECT-R 2
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMDKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRKFTKKDQQTEE

SEQ ID NO: 30823 - protein, 809 aa, Staphylococcus aureus; identical to SEQ ID NO: 30632
  strain ECT-R 2

SEQ ID NO: 30824 - protein, 141 aa, Staphylococcus aureus; identical to SEQ ID NO: 30633
  strain ECT-R 2

SEQ ID NO: 30825 - protein, 645 aa, Staphylococcus aureus; identical to SEQ ID NO: 30601
  strain ECT-R 2

SEQ ID NO: 30826 - protein, 350 aa, Staphylococcus aureus; identical to SEQ ID NO: 30602
  strain ECT-R 2

SEQ ID NO: 30827 - protein, 109 aa, Staphylococcus aureus; identical to SEQ ID NO: 30603
  strain ECT-R 2

SEQ ID NO: 30828 - protein, 165 aa, Staphylococcus aureus; identical to SEQ ID NO: 30418
  strain ECT-R 2

SEQ ID NO: 30829 - protein, 319 aa, Staphylococcus aureus; identical to SEQ ID NO: 30605
  strain ECT-R 2

SEQ ID NO: 30830 - protein, 238 aa, Staphylococcus aureus; identical to SEQ ID NO: 30606
  strain ECT-R 2

SEQ ID NO: 30831 - protein, 241 aa, Staphylococcus aureus; identical to SEQ ID NO: 30607
  strain ECT-R 2

SEQ ID NO: 30832 - protein, 241 aa, Staphylococcus aureus; identical to SEQ ID NO: 30608
  strain ECT-R 2

SEQ ID NO: 30833 - protein, 309 aa, Staphylococcus aureus
  strain ECT-R 2
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRFAVDRKHDAFKNRNVTVKYEVNWKTHEVKIKSITPK

SEQ ID NO: 30834 - protein, 315 aa, Staphylococcus aureus; identical to SEQ ID NO: 30573
  strain ECT-R 2

SEQ ID NO: 30835 - protein, 325 aa, Staphylococcus aureus; identical to SEQ ID NO: 30407
  strain ECT-R 2

SEQ ID NO: 30836 - protein, 372 aa, Staphylococcus aureus; identical to SEQ ID NO: 30609
  strain ECT-R 2

SEQ ID NO: 30837 - protein, 859 aa, Staphylococcus aureus
  strain ECT-R 2
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 30838 - protein, 938 aa, Staphylococcus aureus
  strain ECT-R 2
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 30839 - protein, 1015 aa, Staphylococcus aureus
  strain ECT-R 2
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 30840 - protein, 233 aa, Staphylococcus aureus; identical to SEQ ID NO: 30591
  strain ECT-R 2

SEQ ID NO: 30841 - protein, 211 aa, Staphylococcus aureus; identical to SEQ ID NO: 30592
  strain ECT-R 2

SEQ ID NO: 30842 - protein, 865 aa, Staphylococcus aureus
  strain ECT-R 2
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 30843 - protein, 2271 aa, Staphylococcus aureus
  strain ECT-R 2
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINAVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 30844 - protein, 681 aa, Staphylococcus aureus; identical to SEQ ID NO: 30598
  strain ECT-R 2

SEQ ID NO: 30845 - protein, 680 aa, Staphylococcus aureus
  strain ED98
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 30846 - protein, 434 aa, Staphylococcus aureus [sequence omitted]

SEQ ID NO: 30847 - protein, 981 aa, Staphylococcus aureus
  strain ED98
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSESDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 30848 - protein, 645 aa, Staphylococcus aureus; identical to SEQ ID NO: 30601
  strain ED98

SEQ ID NO: 30849 - protein, 350 aa, Staphylococcus aureus; identical to SEQ ID NO: 30602
  strain ED98

SEQ ID NO: 30850 - protein, 109 aa, Staphylococcus aureus; identical to SEQ ID NO: 30603
  strain ED98

SEQ ID NO: 30851 - protein, 165 aa, Staphylococcus aureus; identical to SEQ ID NO: 30418
  strain ED98

SEQ ID NO: 30852 - protein, 319 aa, Staphylococcus aureus; identical to SEQ ID NO: 30605
  strain ED98

SEQ ID NO: 30853 - protein, 238 aa, Staphylococcus aureus; identical to SEQ ID NO: 30606
  strain ED98

SEQ ID NO: 30854 - protein, 241 aa, Staphylococcus aureus
  strain ED98
MNNNITKKIILSTTLLLLGTAFTQFPNTPINSSSEAKAYYINQNETNVNELTKYYSQKYLTFSNSTLWQKDNGTIHATLLQFSWYSHIQVYGPESWGNINQLRNKSIDIFGIKDQETIDSFALSQETFTGGVTPAATSNDKHYKLNVTYKDKAETFTGGFPVYEGNKPVLTLKELDFRIRQTLIKSKKLYNNSYNKGQIKITGTDNNYTIDLSKRLPSTDANRYVKKPQNAKIEVILEKSN

SEQ ID NO: 30855 - protein, 241 aa, Staphylococcus aureus; identical to SEQ ID NO: 30608
  strain ED98

SEQ ID NO: 30856 - protein, 372 aa, Staphylococcus aureus; identical to SEQ ID NO: 30609
  strain ED98

SEQ ID NO: 30857 - protein, 62 aa, Staphylococcus aureus; identical to SEQ ID NO: 30610
  strain ED98

SEQ ID NO: 30858 - protein, 138 aa, Staphylococcus aureus; identical to SEQ ID NO: 30785
  strain ED98

SEQ ID NO: 30859 - protein, 291 aa, Staphylococcus aureus; identical to SEQ ID NO: 30390
  strain ED98

SEQ ID NO: 30860 - protein, 912 aa, Staphylococcus aureus
  strain ED98
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESKYLTKYSICMVNFVNNVKAINL

SEQ ID NO: 30861 - protein, 2186 aa, Staphylococcus aureus
  strain ED98
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVIRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30862 - protein, 331 aa, Staphylococcus aureus; identical to SEQ ID NO: 30615
  strain ED98

SEQ ID NO: 30863 - protein, 327 aa, Staphylococcus aureus; identical to SEQ ID NO: 30616
  strain ED98

SEQ ID NO: 30864 - protein, 311 aa, Staphylococcus aureus; identical to SEQ ID NO: 30617
  strain ED98

SEQ ID NO: 30865 - protein, 258 aa, Staphylococcus aureus; identical to SEQ ID NO: 30410
  strain ED98

SEQ ID NO: 30866 - protein, 165 aa, Staphylococcus aureus; identical to SEQ ID NO: 30805
  strain ED98

SEQ ID NO: 30867 - protein, 131 aa, Staphylococcus aureus
  strain ED98
MYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 30868 - protein, 242 aa, Staphylococcus aureus; identical to SEQ ID NO: 30399
  strain ED98

SEQ ID NO: 30869 - protein, 239 aa, Staphylococcus aureus; identical to SEQ ID NO: 30622
  strain ED98

SEQ ID NO: 30870 - protein, 254 aa, Staphylococcus aureus; identical to SEQ ID NO: 30809
  strain ED98

SEQ ID NO: 30871 - protein, 96 aa, Staphylococcus aureus; identical to SEQ ID NO: 30813
  strain ED98

SEQ ID NO: 30872 - protein, 274 aa, Staphylococcus aureus
  strain ED98
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 30873 - protein, 338 aa, Staphylococcus aureus; identical to SEQ ID NO: 30627
  strain ED98

SEQ ID NO: 30874 - protein, 351 aa, Staphylococcus aureus; identical to SEQ ID NO: 30628
  strain ED98

SEQ ID NO: 30875 - protein, 44 aa, Staphylococcus aureus; identical to SEQ ID NO: 30513
  strain ED98

SEQ ID NO: 30876 - protein, 231 aa, Staphylococcus aureus; identical to SEQ ID NO: 30630
  strain ED98

SEQ ID NO: 30877 - protein, 241 aa, Staphylococcus aureus
  strain ED98
MKKLATVGFLIVTSTLVFSSMPFQNAHADTTSMNVPNKQSQNVQNHRPYGGVVPQGMTQAQYTELEKTLPQLSAGSNMQDYNMKLYDATQNIADKYNVIITTNVGVFKPHAVRDMNGHALPLTKDGNFYQTNVDANGVNHGGSEMVQNKTGHMSQQDHMNQNTHMNQQPQIQQGHMQSSNHQMMSPKANMHSSNHQMNQSNKKVLPAAGESMTSSILTASIAALLLVSGLFLAFRRRSTNK

SEQ ID NO: 30878 - protein, 2481 aa, Staphylococcus aureus
  strain ED98
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSPDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 30879 - protein, 809 aa, Staphylococcus aureus; identical to SEQ ID NO: 30632
  strain ED98

SEQ ID NO: 30880 - protein, 141 aa, Staphylococcus aureus; identical to SEQ ID NO: 30633
  strain ED98

SEQ ID NO: 30881 - protein, 691 aa, Staphylococcus aureus; identical to SEQ ID NO: 30511
  strain ED98

SEQ ID NO: 30882 - protein, 203 aa, Staphylococcus aureus; identical to SEQ ID NO: 30576
  strain ED98

SEQ ID NO: 30883 - protein, 226 aa, Staphylococcus aureus; identical to SEQ ID NO: 30577
  strain ED98

SEQ ID NO: 30884 - protein, 231 aa, Staphylococcus aureus; identical to SEQ ID NO: 30578
  strain ED98

SEQ ID NO: 30885 - protein, 356 aa, Staphylococcus aureus; identical to SEQ ID NO: 30793
  strain ED98

SEQ ID NO: 30886 - protein, 292 aa, Staphylococcus aureus; identical to SEQ ID NO: 30580
  strain ED98

SEQ ID NO: 30887 - protein, 234 aa, Staphylococcus aureus; identical to SEQ ID NO: 30581
  strain ED98

SEQ ID NO: 30888 - protein, 231 aa, Staphylococcus aureus; identical to SEQ ID NO: 30582
  strain ED98

SEQ ID NO: 30889 - protein, 232 aa, Staphylococcus aureus; identical to SEQ ID NO: 30583
  strain ED98

SEQ ID NO: 30890 - protein, 232 aa, Staphylococcus aureus; identical to SEQ ID NO: 30584
  strain ED98

SEQ ID NO: 30891 - protein, 227 aa, Staphylococcus aureus; identical to SEQ ID NO: 30585
  strain ED98

SEQ ID NO: 30892 - protein, 227 aa, Staphylococcus aureus; identical to SEQ ID NO: 30586
  strain ED98

SEQ ID NO: 30893 - protein, 309 aa, Staphylococcus aureus; identical to SEQ ID NO: 30406
  strain ED98

SEQ ID NO: 30894 - protein, 315 aa, Staphylococcus aureus; identical to SEQ ID NO: 30573
  strain ED98

SEQ ID NO: 30895 - protein, 325 aa, Staphylococcus aureus; identical to SEQ ID NO: 30407
  strain ED98

SEQ ID NO: 30896 - protein, 987 aa, Staphylococcus aureus
  strain ED98
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 30897 - protein, 938 aa, Staphylococcus aureus
  strain ED98
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHQADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 30898 - protein, 1015 aa, Staphylococcus aureus; identical to SEQ ID NO: 30839
  strain ED98

SEQ ID NO: 30899 - protein, 979 aa, Staphylococcus aureus
  strain ED98
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 30900 - protein, 1385 aa, Staphylococcus aureus
  strain ED98
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKNNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKGHHNKAKALPETGNENSGSNNATLFGGLFAALGSLLLFGRRKKQNK

SEQ ID NO: 30901 - protein, 1141 aa, Staphylococcus aureus
  strain ED98
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30902 - protein, 233 aa, Staphylococcus aureus; identical to SEQ ID NO: 30591
  strain ED98

SEQ ID NO: 30903 - protein, 211 aa, Staphylococcus aureus; identical to SEQ ID NO: 30592
  strain ED98

SEQ ID NO: 30904 - protein, 877 aa, Staphylococcus aureus; identical to SEQ ID NO: 30593
  strain ED98

SEQ ID NO: 30905 - protein, 2271 aa, Staphylococcus aureus; identical to SEQ ID NO: 30597
  strain ED98

SEQ ID NO: 30906 - protein, 520 aa, Staphylococcus aureus
  strain JH1
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 30907 - protein, 241 aa, Staphylococcus aureus; identical to SEQ ID NO: 30571
  strain JH1

SEQ ID NO: 30908 - protein, 645 aa, Staphylococcus aureus
  strain JH1
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWD

SEQ ID NO: 30909 - protein, 203 aa, Staphylococcus aureus; identical to SEQ ID NO: 30576
  strain JH1

SEQ ID NO: 30910 - protein, 226 aa, Staphylococcus aureus; identical to SEQ ID NO: 30577
  strain JH1

SEQ ID NO: 30911 - protein, 231 aa, Staphylococcus aureus; identical to SEQ ID NO: 30578
  strain JH1

SEQ ID NO: 30912 - protein, 356 aa, Staphylococcus aureus; identical to SEQ ID NO: 30579
  strain JH1

SEQ ID NO: 30913 - protein, 292 aa, Staphylococcus aureus; identical to SEQ ID NO: 30580
  strain JH1

SEQ ID NO: 30914 - protein, 234 aa, Staphylococcus aureus; identical to SEQ ID NO: 30581
  strain JH1

SEQ ID NO: 30915 - protein, 231 aa, Staphylococcus aureus; identical to SEQ ID NO: 30582
  strain JH1

SEQ ID NO: 30916 - protein, 232 aa, Staphylococcus aureus; identical to SEQ ID NO: 30583
  strain JH1

SEQ ID NO: 30917 - protein, 232 aa, Staphylococcus aureus; identical to SEQ ID NO: 30584
  strain JH1

SEQ ID NO: 30918 - protein, 227 aa, Staphylococcus aureus; identical to SEQ ID NO: 30585
  strain JH1

SEQ ID NO: 30919 - protein, 227 aa, Staphylococcus aureus; identical to SEQ ID NO: 30586
  strain JH1

SEQ ID NO: 30920 - protein, 965 aa, Staphylococcus aureus
  strain JH1
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 30921 - protein, 1337 aa, Staphylococcus aureus; identical to SEQ ID NO: 30811
  strain JH1

SEQ ID NO: 30922 - protein, 1153 aa, Staphylococcus aureus
  strain JH1
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30923 - protein, 434 aa, Staphylococcus aureus [sequence omitted]

SEQ ID NO: 30924 - protein, 905 aa, Staphylococcus aureus
  strain JH1
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSPVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 30925 - protein, 645 aa, Staphylococcus aureus; identical to SEQ ID NO: 30601
  strain JH1

SEQ ID NO: 30926 - protein, 350 aa, Staphylococcus aureus; identical to SEQ ID NO: 30602
  strain JH1

SEQ ID NO: 30927 - protein, 227 aa, Staphylococcus aureus
  strain JH1
MKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYAIPVASLALLIAITLFVRKKSKGNVE

SEQ ID NO: 30928 - protein, 109 aa, Staphylococcus aureus; identical to SEQ ID NO: 30603
  strain JH1

SEQ ID NO: 30929 - protein, 165 aa, Staphylococcus aureus; identical to SEQ ID NO: 30418
  strain JH1

SEQ ID NO: 30930 - protein, 319 aa, Staphylococcus aureus; identical to SEQ ID NO: 30605
  strain JH1

SEQ ID NO: 30931 - protein, 238 aa, Staphylococcus aureus; identical to SEQ ID NO: 30606
  strain JH1

SEQ ID NO: 30932 - protein, 241 aa, Staphylococcus aureus; identical to SEQ ID NO: 30607
  strain JH1

SEQ ID NO: 30933 - protein, 241 aa, Staphylococcus aureus; identical to SEQ ID NO: 30608
  strain JH1

SEQ ID NO: 30934 - protein, 372 aa, Staphylococcus aureus; identical to SEQ ID NO: 30609
  strain JH1

SEQ ID NO: 30935 - protein, 291 aa, Staphylococcus aureus; identical to SEQ ID NO: 30390
  strain JH1

SEQ ID NO: 30936 - protein, 891 aa, Staphylococcus aureus; identical to SEQ ID NO: 30788
  strain JH1

SEQ ID NO: 30937 - protein, 2186 aa, Staphylococcus aureus
  strain JH1
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEENAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 30938 - protein, 331 aa, Staphylococcus aureus; identical to SEQ ID NO: 30615
  strain JH1

SEQ ID NO: 30939 - protein, 239 aa, Staphylococcus aureus
  strain JH1
MNKNIIIKSIAALTILTSITGVGTTVVDGIQQTAKAENSVKLITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 30940 - protein, 239 aa, Staphylococcus aureus; identical to SEQ ID NO: 30476
  strain JH1

SEQ ID NO: 30941 - protein, 240 aa, Staphylococcus aureus; identical to SEQ ID NO: 30475
  strain JH1

SEQ ID NO: 30942 - protein, 235 aa, Staphylococcus aureus
  strain JH1
MNKNVMVKGLTALTILTSLGFAENISNQPHSIAKAEKNVKEITDATKAPYNSVVAFAGGTGVVVGKNTIVTNKHIAKSNDIFKNRVAAHYSSKGKGGGNYDVKDIVEYPGKEDLAIVHVHETSTEGLNFNKNVSYTKFAEGAKAKDRISVIGYPKGAQTKYKMFESTGTINHISGTFIEFDAYAQPGNSGSPVLNSKHELIGILYAGSGKDESEKNFGVYFTPQLKEFIQNNIEK

SEQ ID NO: 30943 - protein, 327 aa, Staphylococcus aureus; identical to SEQ ID NO: 30616
  strain JH1

SEQ ID NO: 30944 - protein, 311 aa, Staphylococcus aureus
  strain JH1
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGAKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 30945 - protein, 258 aa, Staphylococcus aureus; identical to SEQ ID NO: 30410
  strain JH1

SEQ ID NO: 30946 - protein, 251 aa, Staphylococcus aureus
  strain JH1
MRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 30947 - protein, 242 aa, Staphylococcus aureus; identical to SEQ ID NO: 30399
  strain JH1

SEQ ID NO: 30948 - protein, 239 aa, Staphylococcus aureus; identical to SEQ ID NO: 30622
  strain JH1

SEQ ID NO: 30949 - protein, 254 aa, Staphylococcus aureus; identical to SEQ ID NO: 30809
  strain JH1

SEQ ID NO: 30950 - protein, 274 aa, Staphylococcus aureus; identical to SEQ ID NO: 30815
  strain JH1

SEQ ID NO: 30951 - protein, 338 aa, Staphylococcus aureus; identical to SEQ ID NO: 30627
  strain JH1

SEQ ID NO: 30952 - protein, 351 aa, Staphylococcus aureus; identical to SEQ ID NO: 30628
  strain JH1

SEQ ID NO: 30953 - protein, 26 aa, Staphylococcus aureus
  strain JH1
MAQDIISTIGDLVKWIIDTVNKFTKK

SEQ ID NO: 30954 - protein, 231 aa, Staphylococcus aureus; identical to SEQ ID NO: 30630
  strain JH1

SEQ ID NO: 30955 - protein, 2481 aa, Staphylococcus aureus; identical to SEQ ID NO: 30631
  strain JH1

SEQ ID NO: 30956 - protein, 809 aa, Staphylococcus aureus; identical to SEQ ID NO: 30632
  strain JH1

SEQ ID NO: 30957 - protein, 141 aa, Staphylococcus aureus; identical to SEQ ID NO: 30633
  strain JH1

SEQ ID NO: 30958 - protein, 436 aa, Staphylococcus aureus
  strain JH1
MKNKYISKLLVGAATITLATMISNGEAKASENTQQTSTKHQTTQNNYVTDQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNEKDSIENRRLAQREVNKAPMDVKEHLQKQLDALVAQKDAEKKVAPKVEAPQIQSPQIEKPKAESPKVEVPQIQSPKVEVPQSKLLGYYQSLKDSFNYGYKYLTDTYKSYKEKYDTAKYYYNTYYKYKGAIDQTVLTVLGSGSKSYIQPLKVDDKNGYLAKSYAQVRNYVTESINTGKVLYTFYQNPTLVKTAIKAQETASSIKNTLSNLLSFWK

SEQ ID NO: 30959 - protein, 321 aa, Staphylococcus aureus
  strain JH1
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 30960 - protein, 315 aa, Staphylococcus aureus; identical to SEQ ID NO: 30573
  strain JH1

SEQ ID NO: 30961 - protein, 325 aa, Staphylococcus aureus; identical to SEQ ID NO: 30407
  strain JH1

SEQ ID NO: 30962 - protein, 987 aa, Staphylococcus aureus
  strain JH1
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 30963 - protein, 961 aa, Staphylococcus aureus; identical to SEQ ID NO: 30589
  strain JH1

SEQ ID NO: 30964 - protein, 1038 aa, Staphylococcus aureus; identical to SEQ ID NO: 30590
  strain JH1

SEQ ID NO: 30965 - protein, 233 aa, Staphylococcus aureus; identical to SEQ ID NO: 30591
  strain JH1

SEQ ID NO: 30966 - protein, 214 aa, Staphylococcus aureus
  strain JH1
MNKMKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 30967 - protein, 877 aa, Staphylococcus aureus; identical to SEQ ID NO: 30593
  strain JH1

SEQ ID NO: 30968 - protein, 2271 aa, Staphylococcus aureus; identical to SEQ ID NO: 30597
  strain JH1

SEQ ID NO: 30969 - protein, 681 aa, Staphylococcus aureus; identical to SEQ ID NO: 30598
  strain JH1

SEQ ID NO: 30970 - protein, 520 aa, Staphylococcus aureus; identical to SEQ ID NO: 30906
  strain JH9

SEQ ID NO: 30971 - protein, 241 aa, Staphylococcus aureus; identical to SEQ ID NO: 30571
  strain JH9

SEQ ID NO: 30972 - protein, 645 aa, Staphylococcus aureus; identical to SEQ ID NO: 30908
  strain JH9

SEQ ID NO: 30973 - protein, 203 aa, Staphylococcus aureus; identical to SEQ ID NO: 30576
  strain JH9

SEQ ID NO: 30974 - protein, 226 aa, Staphylococcus aureus; identical to SEQ ID NO: 30577
  strain JH9

SEQ ID NO: 30975 - protein, 231 aa, Staphylococcus aureus; identical to SEQ ID NO: 30578
  strain JH9

SEQ ID NO: 30976 - protein, 356 aa, Staphylococcus aureus; identical to SEQ ID NO: 30579
  strain JH9

SEQ ID NO: 30977 - protein, 292 aa, Staphylococcus aureus; identical to SEQ ID NO: 30580
  strain JH9

SEQ ID NO: 30978 - protein, 234 aa, Staphylococcus aureus; identical to SEQ ID NO: 30581
  strain JH9

SEQ ID NO: 30979 - protein, 231 aa, Staphylococcus aureus; identical to SEQ ID NO: 30582
  strain JH9

SEQ ID NO: 30980 - protein, 232 aa, Staphylococcus aureus; identical to SEQ ID NO: 30583
  strain JH9

SEQ ID NO: 30981 - protein, 232 aa, Staphylococcus aureus; identical to SEQ ID NO: 30584
  strain JH9

SEQ ID NO: 30982 - protein, 227 aa, Staphylococcus aureus; identical to SEQ ID NO: 30585
  strain JH9

SEQ ID NO: 30983 - protein, 227 aa, Staphylococcus aureus; identical to SEQ ID NO: 30586
  strain JH9

SEQ ID NO: 30984 - protein, 965 aa, Staphylococcus aureus; identical to SEQ ID NO: 30920
  strain JH9

SEQ ID NO: 30985 - protein, 1337 aa, Staphylococcus aureus; identical to SEQ ID NO: 30811
  strain JH9

SEQ ID NO: 30986 - protein, 1153 aa, Staphylococcus aureus; identical to SEQ ID NO: 30922
  strain JH9

SEQ ID NO: 30987 - protein, 434 aa, Staphylococcus aureus [sequence omitted]

SEQ ID NO: 30988 - protein, 905 aa, Staphylococcus aureus; identical to SEQ ID NO: 30924
  strain JH9

SEQ ID NO: 30989 - protein, 645 aa, Staphylococcus aureus; identical to SEQ ID NO: 30601
  strain JH9

SEQ ID NO: 30990 - protein, 350 aa, Staphylococcus aureus; identical to SEQ ID NO: 30602
  strain JH9

SEQ ID NO: 30991 - protein, 227 aa, Staphylococcus aureus; identical to SEQ ID NO: 30927
  strain JH9

SEQ ID NO: 30992 - protein, 109 aa, Staphylococcus aureus; identical to SEQ ID NO: 30603
  strain JH9

SEQ ID NO: 30993 - protein, 165 aa, Staphylococcus aureus; identical to SEQ ID NO: 30418
  strain JH9

SEQ ID NO: 30994 - protein, 319 aa, Staphylococcus aureus; identical to SEQ ID NO: 30605
  strain JH9

SEQ ID NO: 30995 - protein, 238 aa, Staphylococcus aureus; identical to SEQ ID NO: 30606
  strain JH9

SEQ ID NO: 30996 - protein, 241 aa, Staphylococcus aureus; identical to SEQ ID NO: 30607
  strain JH9

SEQ ID NO: 30997 - protein, 241 aa, Staphylococcus aureus; identical to SEQ ID NO: 30608
  strain JH9

SEQ ID NO: 30998 - protein, 372 aa, Staphylococcus aureus; identical to SEQ ID NO: 30609
  strain JH9

SEQ ID NO: 30999 - protein, 157 aa, Staphylococcus aureus; identical to SEQ ID NO: 30611
  strain JH9

SEQ ID NO: 31000 - protein, 291 aa, Staphylococcus aureus; identical to SEQ ID NO: 30390
  strain JH9

SEQ ID NO: 31001 - protein, 891 aa, Staphylococcus aureus; identical to SEQ ID NO: 30788
  strain JH9

SEQ ID NO: 31002 - protein, 2186 aa, Staphylococcus aureus; identical to SEQ ID NO: 30937
  strain JH9

SEQ ID NO: 31003 - protein, 331 aa, Staphylococcus aureus; identical to SEQ ID NO: 30615
  strain JH9

SEQ ID NO: 31004 - protein, 239 aa, Staphylococcus aureus; identical to SEQ ID NO: 30939
  strain JH9

SEQ ID NO: 31005 - protein, 239 aa, Staphylococcus aureus; identical to SEQ ID NO: 30476
  strain JH9

SEQ ID NO: 31006 - protein, 240 aa, Staphylococcus aureus; identical to SEQ ID NO: 30475
  strain JH9

SEQ ID NO: 31007 - protein, 235 aa, Staphylococcus aureus; identical to SEQ ID NO: 30942
  strain JH9

SEQ ID NO: 31008 - protein, 327 aa, Staphylococcus aureus; identical to SEQ ID NO: 30616
  strain JH9

SEQ ID NO: 31009 - protein, 311 aa, Staphylococcus aureus; identical to SEQ ID NO: 30944
  strain JH9

SEQ ID NO: 31010 - protein, 258 aa, Staphylococcus aureus; identical to SEQ ID NO: 30410
  strain JH9

SEQ ID NO: 31011 - protein, 251 aa, Staphylococcus aureus; identical to SEQ ID NO: 30946
  strain JH9

SEQ ID NO: 31012 - protein, 242 aa, Staphylococcus aureus; identical to SEQ ID NO: 30399
  strain JH9

SEQ ID NO: 31013 - protein, 239 aa, Staphylococcus aureus; identical to SEQ ID NO: 30622
  strain JH9

SEQ ID NO: 31014 - protein, 254 aa, Staphylococcus aureus; identical to SEQ ID NO: 30809
  strain JH9

SEQ ID NO: 31015 - protein, 96 aa, Staphylococcus aureus; identical to SEQ ID NO: 30813
  strain JH9

SEQ ID NO: 31016 - protein, 274 aa, Staphylococcus aureus; identical to SEQ ID NO: 30815
  strain JH9

SEQ ID NO: 31017 - protein, 338 aa, Staphylococcus aureus; identical to SEQ ID NO: 30627
  strain JH9

SEQ ID NO: 31018 - protein, 351 aa, Staphylococcus aureus; identical to SEQ ID NO: 30628
  strain JH9

SEQ ID NO: 31019 - protein, 26 aa, Staphylococcus aureus
  strain JH9
MAQDIISTIGDLVKWIIDTVNKFTKK

SEQ ID NO: 31020 - protein, 231 aa, Staphylococcus aureus; identical to SEQ ID NO: 30630
  strain JH9

SEQ ID NO: 31021 - protein, 2481 aa, Staphylococcus aureus; identical to SEQ ID NO: 30631
  strain JH9

SEQ ID NO: 31022 - protein, 809 aa, Staphylococcus aureus; identical to SEQ ID NO: 30632
  strain JH9

SEQ ID NO: 31023 - protein, 141 aa, Staphylococcus aureus; identical to SEQ ID NO: 30633
  strain JH9

SEQ ID NO: 31024 - protein, 436 aa, Staphylococcus aureus; identical to SEQ ID NO: 30958
  strain JH9

SEQ ID NO: 31025 - protein, 321 aa, Staphylococcus aureus; identical to SEQ ID NO: 30959
  strain JH9

SEQ ID NO: 31026 - protein, 315 aa, Staphylococcus aureus; identical to SEQ ID NO: 30573
  strain JH9

SEQ ID NO: 31027 - protein, 325 aa, Staphylococcus aureus; identical to SEQ ID NO: 30407
  strain JH9

SEQ ID NO: 31028 - protein, 987 aa, Staphylococcus aureus; identical to SEQ ID NO: 30962
  strain JH9

SEQ ID NO: 31029 - protein, 961 aa, Staphylococcus aureus; identical to SEQ ID NO: 30589
  strain JH9

SEQ ID NO: 31030 - protein, 1038 aa, Staphylococcus aureus; identical to SEQ ID NO: 30590
  strain JH9

SEQ ID NO: 31031 - protein, 233 aa, Staphylococcus aureus; identical to SEQ ID NO: 30591
  strain JH9

SEQ ID NO: 31032 - protein, 214 aa, Staphylococcus aureus; identical to SEQ ID NO: 30966
  strain JH9

SEQ ID NO: 31033 - protein, 877 aa, Staphylococcus aureus; identical to SEQ ID NO: 30593
  strain JH9

SEQ ID NO: 31034 - protein, 2271 aa, Staphylococcus aureus; identical to SEQ ID NO: 30597
  strain JH9

SEQ ID NO: 31035 - protein, 681 aa, Staphylococcus aureus; identical to SEQ ID NO: 30598
  strain JH9

SEQ ID NO: 31036 - protein, 221 aa, Staphylococcus aureus
  strain JKD6008
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPVTKDGNFYQTNVDANGVNHGGSEMVQNKTGHMNQNTHMNQQPHMQQGHMQSSNHQMNQSNKKVLPAAGESMTSSILTASIAALLLVSGLFLAFRQRSTNK

SEQ ID NO: 31037 - protein, 917 aa, Staphylococcus aureus
  strain JKD6008
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 31038 - protein, 995 aa, Staphylococcus aureus
  strain JKD6008
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 31039 - protein, 233 aa, Staphylococcus aureus
  strain JKD6008
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVPASTWAAIIARESNGQVNAYNPSGASGLFQTMPGWGPTNTVDQQINAAVKAYKAQGLGAWGF

SEQ ID NO: 31040 - protein, 691 aa, Staphylococcus aureus
  strain JKD6008
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLNGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 31041 - protein, 837 aa, Staphylococcus aureus
  strain JKD6008
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 31042 - protein, 203 aa, Staphylococcus aureus; identical to SEQ ID NO: 30770
  strain JKD6008

SEQ ID NO: 31043 - protein, 250 aa, Staphylococcus aureus
  strain JKD6008
MGEFEVKYLTGFILILLLEGIFTNSASAIEYSDLHHKSKFDSKRLSNAKMSFINPTQLENKNTNDRLLKHDLLFHDMFVNDDWKKDFKVEFENEALSKIFINKDIDIFAGNYGYGCHGGATNKTQCSYGGVTLSDNNKYDDYKNIPCNLWIDGHQTEIELTAVKTKKKIVTIQELEVQLRNYLNEKYKLYEQGGDIVKGYVKYYNDDEQNVEYDFYNLNGEYGREVLKMYADNKTINSDKLHLDIYLFKS

SEQ ID NO: 31044 - protein, 291 aa, Staphylococcus aureus
  strain JKD6008
MKKIEAWLSKKGLKNKRTLIVVIAFVLFIIFLFLLLNSNSEDSGNITKTENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 31045 - protein, 1759 aa, Staphylococcus aureus
  strain JKD6008
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSVSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSASESESDSQSISTSASDSTSESTSTSLSDSTSTSNSTSESTSKAISTSASASESDSSSTSLSDSTSASMQSSESDSQSTSASLSNSQSTSTSNRMSTITSESVSESTSESGSTSESTSESDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 31046 - protein, 681 aa, Staphylococcus aureus
  strain JKD6008
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 31047 - protein, 797 aa, Staphylococcus aureus
  strain JKD6008
MLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31048 - protein, 226 aa, Staphylococcus aureus; identical to SEQ ID NO: 30769
  strain JKD6008

SEQ ID NO: 31049 - protein, 231 aa, Staphylococcus aureus; identical to SEQ ID NO: 30768
  strain JKD6008

SEQ ID NO: 31050 - protein, 352 aa, Staphylococcus aureus; identical to SEQ ID NO: 30767
  strain JKD6008

SEQ ID NO: 31051 - protein, 308 aa, Staphylococcus aureus
  strain JKD6008
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPNFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 31052 - protein, 234 aa, Staphylococcus aureus
  strain JKD6008
MKMTAIAKASLALGILATGTITSLHQTVNASEHKAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 31053 - protein, 231 aa, Staphylococcus aureus; identical to SEQ ID NO: 30560
  strain JKD6008

SEQ ID NO: 31054 - protein, 232 aa, Staphylococcus aureus
  strain JKD6008
MKFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 31055 - protein, 232 aa, Staphylococcus aureus; identical to SEQ ID NO: 30765
  strain JKD6008

SEQ ID NO: 31056 - protein, 227 aa, Staphylococcus aureus; identical to SEQ ID NO: 30585
  strain JKD6008

SEQ ID NO: 31057 - protein, 225 aa, Staphylococcus aureus; identical to SEQ ID NO: 30763
  strain JKD6008

SEQ ID NO: 31058 - protein, 895 aa, Staphylococcus aureus; identical to SEQ ID NO: 30734
  strain JKD6008

SEQ ID NO: 31059 - protein, 2186 aa, Staphylococcus aureus
  strain JKD6008
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 31060 - protein, 331 aa, Staphylococcus aureus; identical to SEQ ID NO: 30732
  strain JKD6008

SEQ ID NO: 31061 - protein, 1346 aa, Staphylococcus aureus
  strain JKD6008
MGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 31062 - protein, 1133 aa, Staphylococcus aureus
  strain JKD6008
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31063 - protein, 434 aa, Staphylococcus aureus [sequence omitted]

SEQ ID NO: 31064 - protein, 931 aa, Staphylococcus aureus
  strain JKD6008
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 31065 - protein, 242 aa, Staphylococcus aureus; identical to SEQ ID NO: 30396
  strain JKD6008

SEQ ID NO: 31066 - protein, 242 aa, Staphylococcus aureus
  strain JKD6008
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDAENFHLDVEISYEKTE

SEQ ID NO: 31067 - protein, 172 aa, Staphylococcus aureus; identical to SEQ ID NO: 30248
  strain JKD6008

SEQ ID NO: 31068 - protein, 260 aa, Staphylococcus aureus
  strain JKD6008
MSKMKKTAFTLLLFIALTLTTSPLVNGSEKSEEINEKDLRKKSELQGTALGNLKQIYYYNEKAKTENKESHDQFLQHTILFKGFFTDHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQYSNTLLRIYRDNKTINSENMHIDIYLYTS

SEQ ID NO: 31069 - protein, 274 aa, Staphylococcus aureus; identical to SEQ ID NO: 30872
  strain JKD6008

SEQ ID NO: 31070 - protein, 338 aa, Staphylococcus aureus
  strain JKD6008
MIKQLCKNITICTLALSTTFTVLPATSFAKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDEKEEKLSALYEVDWKTHNVKFVKVLNDNEKK

SEQ ID NO: 31071 - protein, 351 aa, Staphylococcus aureus; identical to SEQ ID NO: 30720
  strain JKD6008

SEQ ID NO: 31072 - protein, 44 aa, Staphylococcus aureus; identical to SEQ ID NO: 30513
  strain JKD6008

SEQ ID NO: 31073 - protein, 231 aa, Staphylococcus aureus
  strain JKD6008
MKKTLLASSLAVGLGIVAGNAGHEAHASEADLNKASLAQMAQSNDQTLNQKPIEAGAYNYTFDYEGFTYHFESDGTHFAWNYHATGTNGADMSAQAPATNNVAPSAVQANQVQSQEVEAPQNAQTQQPQASTSNNSQVTATPTESKSSEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 31074 - protein, 645 aa, Staphylococcus aureus; identical to SEQ ID NO: 30747
  strain JKD6008

SEQ ID NO: 31075 - protein, 350 aa, Staphylococcus aureus; identical to SEQ ID NO: 30602
  strain JKD6008

SEQ ID NO: 31076 - protein, 109 aa, Staphylococcus aureus; identical to SEQ ID NO: 30744
  strain JKD6008

SEQ ID NO: 31077 - protein, 165 aa, Staphylococcus aureus; identical to SEQ ID NO: 30742
  strain JKD6008

SEQ ID NO: 31078 - protein, 319 aa, Staphylococcus aureus
  strain JKD6008
MKTHIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 31079 - protein, 238 aa, Staphylococcus aureus; identical to SEQ ID NO: 30740
  strain JKD6008

SEQ ID NO: 31080 - protein, 241 aa, Staphylococcus aureus; identical to SEQ ID NO: 30739
  strain JKD6008

SEQ ID NO: 31081 - protein, 241 aa, Staphylococcus aureus
  strain JKD6008
MKKNIMNKLVLSTALLLLETTSTQLPKTPISFSSEAKAYNISENETNINELIKYYNQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEIEVILEKSN

SEQ ID NO: 31082 - protein, 807 aa, Staphylococcus aureus
  strain JKD6008
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITSKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 31083 - protein, 141 aa, Staphylococcus aureus; identical to SEQ ID NO: 30715
  strain JKD6008

SEQ ID NO: 31084 - protein, 372 aa, Staphylococcus aureus
  strain JKD6008
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31085 - protein, 190 aa, Staphylococcus aureus; identical to SEQ ID NO: 30534
  strain JKD6008

SEQ ID NO: 31086 - protein, 438 aa, Staphylococcus aureus
  strain JKD6008
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDRQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31087 - protein, 321 aa, Staphylococcus aureus; identical to SEQ ID NO: 30959
  strain JKD6008

SEQ ID NO: 31088 - protein, 315 aa, Staphylococcus aureus; identical to SEQ ID NO: 30440
  strain JKD6008

SEQ ID NO: 31089 - protein, 325 aa, Staphylococcus aureus; identical to SEQ ID NO: 30407
  strain JKD6008

SEQ ID NO: 31090 - protein, 327 aa, Staphylococcus aureus
  strain JKD6159
MKMKKLVKSSVATSIALLMLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 31091 - protein, 311 aa, Staphylococcus aureus
  strain JKD6159
MFKKKMLAATLSVGLIAPLASPIHESRANTNIENIGDGAEVIKRTEDVSSKKWGVTQNVQFDFVKDKKYNKDALIVKMQGFINSRTSFSDVKGSGYELTKRMIWPFQYNIGLMTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPSGSAREYFAPDNQLPPLIQSGFNPSFITTISHEKGTSETSEFEISYGRNLDITYATLFPRTGIYAERKHNAFVNRNFVVRYEVNWKTHEIKVKGHN

SEQ ID NO: 31092 - protein, 96 aa, Staphylococcus aureus
  strain JKD6159
MKFPVTINKFENLVSNEFVFYNARKITINDLSIKLKSAMANDQGITKHDIGLAERAVYKVYFKNGSSKYVDLKTEYKDGKVFKATDIKKVDIELKF

SEQ ID NO: 31093 - protein, 479 aa, Staphylococcus aureus
  strain JKD6159
MKFKSLITTTLALGVLASTGANFNTNEASAAAKQLDKSSSSLHHGYSKINVPYTITVNGTSTNILSSLTLNKNQNISYKDLENKVKSVLKSNRGISDIDLRLSKQAKYTVHFKNGTKKVIDLKSGVYTANLINTSDIKAISVNVDTKKHVKDNNKVKANYQVPYTITVNGTSTNILSSLTFKKNQNISYKDLENKVKSVLKSNRGISDIDLRLSKQAKYTVHFKNGTKKVIDLKSGVYTANLINTSNIKSININVDIKKHVKDKAKVNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGPKAKADRYVPYTIAVNGTSTPILSKLKLSQKELISYKYLNDKVKSVLKSERGISDLDLKFAKQAKYTVHFKNGKKQVVNLKSDIFTPNLFSAKDIKKIDIDVKQHTKSKKNK

SEQ ID NO: 31094 - protein, 274 aa, Staphylococcus aureus; identical to SEQ ID NO: 30872
  strain JKD6159

SEQ ID NO: 31095 - protein, 338 aa, Staphylococcus aureus
  strain JKD6159
MIKPLFKNITICSLAISTALTVFPVTSHAKINSEIKQVSEKNLDGDTKMYTRTATTSDSQKNITQSLQFNFLTEPNYDKETVFIKAKGTIGSGLRILEPNGYWNSTLRWPGSYSVSIQNVDDNNNTNVTDFAPKNQDESREVKYTYGYKTGGDFSINRGGLTGNITKESNYSETISYQQPSYRTLLDQSTSNKGVGWKVEAHLINNMGHDHTRQLTNDSDNRTKSEIFSLTRNGNLWAKDNFTPKNKMPVTVSEGFNPEFLAVMSHDKKDKGKSKFVVHYKRSMDEFKIDWNRHGFWGYWSGENHVDKKEEKLSALYEVDWKTHDVKFVKVLNDNEKK

SEQ ID NO: 31096 - protein, 351 aa, Staphylococcus aureus
  strain JKD6159
MKNKKRVLIASSLSCAILLLSAATTQANSAHKDSQDQNKKEHVDKSQQKEKRNVTNKDKNSPVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 31097 - protein, 45 aa, Staphylococcus aureus
  strain JKD6159
MMSCLILRIFILIKEGVISMAQDIISTIGDLVKWIIDTVNKFTKK

SEQ ID NO: 31098 - protein, 231 aa, Staphylococcus aureus
  strain JKD6159
MKKTLLASSLAVGLGIVAGNAGHEAHASEADLNKASLAQMAQSNDQTLNQKPIEAGAYNYTFDYEGFTYHFESDGTHFAWNYHATGANGADMSVQAPATNNVAPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 31099 - protein, 2478 aa, Staphylococcus aureus
  strain JKD6159
MNLFRQQKFSIRKFNVGIFSALIATVTFISTNPTTASAAEQNQPALNQPAQPADANTQPNANAGAQANPAAQPAAPANQGQPAAQPANQGGQANPAGGAAQPNTQPAGQGNQADPNNAAQAQPGNQAAPANQAGQGNNQATPNNNATPANQTQPANAPAAVQPAAPVAANVQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVTNIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVNKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEVIKTKAINDINQTAPSTSAKAAALEEFDEVVQAQIDQAPLNPDTTNEEVAEAIERINAAKVSGVKAIEATTTAQDLERVKNEEIFKIENITDSTQTKMGAYKEVKQAATARKTQNATVSNATDEEVAEADAAVDAAQKEGLHDIQVVKSQQEVAETKTKVLDKINAIQTQARVKPAADAAVENAYNTRKQEIQNSNASTTEEKEAAYAELDAKKQEARTNIDAANSNSDVATAKDNAIAAINQVQAATTKKADAKAEIAQKASERKTAIEAMNASTTEEQQAAKDKVDQAVVTANADIDNAAANTDVDNAKTTNEATIAAITPDANVKPTAKQAIADKVQAQETAIDANNGATTEEKTAAKQQVQTEKTTADAAIDGAHSNAEVEAAKNAEIAKIEAIQPATTTKDDAKQAIATKANERKTAIAQTQDITAEEIAAANADVDNAATQANSNIEAANSQNDVDQAKTNGETSIDQVTPTVNKKATARNEITTVLNNKLQEIQATPDATDEEKQAAETEANTENAKANQVITAATTNAEVDEAKTNAETAINAVTPKVMKKQAAKDEIDQLQAAQTAVINNDQNATNEEKEAAIQQLATAVTDAKNNITAATDDNGVDQAKDAGKNSIQSTQPATAVKSNAKNDVDQAVTAQNQAIDNTTGATTEEKNAAKDLVSKAKEKAYQDILNAQTTNDVTQIKDQAVADIQGITADTTIKDVAKDELATKANDQKAQIAQAADATTEEKEQANQQVDAQLTQGNQNIENAQSIDDVNTAKDNAIQAIDPIQAATDVKTNARAELLNEMQNKITEILSDNTTTNEEKGKDIEPVRAAYEEGLNNINAANTTGDVSTAKDTAVQKVQQLHANPVKKPAGKTELDQVATDKKTQIEQTPNASQQEINDAKQEVDAALNQAKTNVDQSSTNEYVDNAVKEGKAKINAVKTFSEYKKDALAKIEAAYNSKVNEADNSNASTSSEIAEAKQKLAELKQTADQNVNQATSKDDIEVQIHNDLDNINDYTIPTGKKESATTDLYAYADQKKNNISADTNATQDEKQQAINQVNQNVQTALESINNGVDNGDVDDALTQGKAAIDAVQVDATVKPKANQAIDAKAEDTKDSIEHSDQLTSEEKAEALATIKQITDQAKKGITDATTTAEVEKAKAQGLEAFDNIQIDSTHKQQAIEELETALDKIEANVNANTDATIEEKEAFTNTLEDILSKATEDISDQTTNAEIETVKNNALEKLKGQQINPEAKKNALKEIENAVNKQKETINNADANKAAKETALNDLSRSHDRFVEDLVKVQSNAEVAELQNVTIPAIEAIVPQNDPDANDTNNGTDNNDATANSNATPENTGQPNVSETTDNGKADASPTTSNNSDAATGETTATSATDDANDKPQANSNSSVDASTNSPTMDNDVTSKPEVESTNNGTTDKPVTETDNATPAESTINNNSTTTATNENAPTGSTATAPTTASTEAASSADSKDNASVNDSKQNAEVNNSAESQSTNGKVAQPKSENKAKAEKDDRDSTNQSMVESTTETLPSADITEPNVPSNTSKDKEESTSNQTDAGQLKSETNVASNETDKSPSKADTEVSNKPSTSASSEAKDKMTSTNVSQKDDTATADTNDTQKSVGPVANNKAKDMQTNDMKASLVTVSNGSNSANQDMLNVTKTEENKANAKSAQQGKVNKPKQQTKTLPDTGMSHNDDLPYAELALGAGMAFLIRRFTKKDQQTEE

SEQ ID NO: 31100 - protein, 259 aa, Staphylococcus aureus
  strain JKD6159
MRKVLILITLLFGYSCYLLLEAKAETQNDPNISELNKASQYTGSWHNIWYLYNSDPVKAKKTKLSDKFLSHDFIVPINSPGHYDYVKTELKDSTMASSFDGKEVDIFGVNYFHQCYFSNENIQCDSNQGAGSKKTCMYGGITLNENNTNNRIQPIVVKVYENDSVTLSFDINIDKETVTIQELDYKVRNKLISKINLYHLGGTSYETGYIKFIENANRYYWYDMMPDPSFTQSKYLMIYRGNETVESAKTEIEVHLTKK

SEQ ID NO: 31101 - protein, 805 aa, Staphylococcus aureus
  strain JKD6159
MTYRMKKWQKLSTITLLMAGVITLNDGEFRSVDKHRIAVADTNTQTPNYEKLRNTWLDVNYSYNQYDEKNDAMKKKFEATEKEAEKLLKEMKTESGRTYLWAGAENLETNSSHMTRTYRNIEKIAEAMKHKNTKLKTDENKTKVKEALEWLHKNAYGKEPLKKLEELKTNFSKSAPQKNTNLNWWDYEIGTPRALTNTLLLLNGDISNDEKKKYTAPIKTFAPNSDKILSSVGQPEQAKGGNLVDITKVKLLESIIEEDKDMMKKSIDSFNKVFTYVQDSATGKERNGFYKDGSYIDHKDVPYTGAYGVVLLEGISQMMPMIKETPFKETSQKDTILKSWIDDGFMPLIYKSEMMDLSRGRAISRENETSHTASATVMKSLLRLSDAVDESTKAKYKKIVKTSVKSDSSYKQTDYLNSYSDIDKMKSLMADSTISTNGLTQQLKIYNDMDRVTYHNKDLDFAFGLSMTSKNVARYESINNENLKGWHTGAGMSYLYNSDVKHYRDNFWATADMTRLPGTTTLNDMPSTNTKNNNSFVGGTKLNNKYASIGMDFENQNKTLTAKKSYFILNDKIVFLGTGIKSTDSSKNPMTTVENRKANEYTMYKDDKQTTASNDEETNSVFLESTDNKKNIGYHFLNKPKITVKKESQTGKWSEINKSQKSDDKKDEYYEVTQKHSNTDSKYAYVLYPGITKDNFKSKASQVSIVKQDDDFHVVKDNESVWAGVNYSDSAKTFEINGTKVEVKDKGMFILKKKDDKTYECSFYNPESTNTASDIESKISMTGYSITNKNASTTNESGVRFELTK

SEQ ID NO: 31102 - protein, 492 aa, Staphylococcus aureus
  strain JKD6159
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31103 - protein, 241 aa, Staphylococcus aureus
  strain JKD6159
MKKLATVGSLIVTSTFVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 31104 - protein, 309 aa, Staphylococcus aureus
  strain JKD6159
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDPNVDLINYLPKNKIDSADVSQKLGYNIGGNFQTAPSIGGSGSFNYSKTISYNQKNYVTEVESQNSKGVKWGIKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 31105 - protein, 315 aa, Staphylococcus aureus
  strain JKD6159
MLKNKMLATTLSISLIAPLATPLFENAKAANDTEDIGKGSDVEIIKRTEDKTSNKWGVTQNIQFDFVKDKKYNKDALILKMQGFISSRTAYYNYKKSNHVKAMRWPFQYNIGLKTNDPNVSLINYLPKNKIESTNVSQTLGYNIGGNFQSAPSLGGNGSFNYSKSISYTQQNYVSEVEQQNSKGVLWGVKANSFATESGQKSAFDSDLFVGYKPHSKDPRDYFVPDSELPPLVQSGFNPSFIATVSHEKGSGDTSEFEITYGRNMDVTHAIKRSTHYGNSYLDGHRVHNAFVNRNYTVKYEVNWKTHEIKVKGQN

SEQ ID NO: 31106 - protein, 325 aa, Staphylococcus aureus
  strain JKD6159
MKMNKLVKSSVATSMALLLLSNTANAEGKITPVSVKKVDDKVTLYKTTATADSDKFKISQILTFNFIKDKSYDKDTLVLKAAGNINSGYEKPNPKDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSSYAGQNFIAQHQMPLLSRSNFNPEFLSVLSHKQNGAKKSKITVTYQREMDLYQIRWNGFYWAGANYKNFKTRTFKSTYEIDWENHKVKLLDTKETEINK

SEQ ID NO: 31107 - protein, 169 aa, Staphylococcus aureus
  strain JKD6159
MRKKSGPINKRVDFLSNRLNKYSIRKFTIGTASILVGSTLIFGIGSGEAKADAKVYTNNENGTKSKHERSEVESAQEAKATENVQETNKVESAQEAKATENVQETNKVESAQEAKATENVQETNKVESAQEAKVTENVQETNKVVSAQEAKATEKCARNEQSREFTATR

SEQ ID NO: 31108 - protein, 691 aa, Staphylococcus aureus
  strain JKD6159
MLRGQEERKYSIRKYSIGVVSVLAATMFVVTSHEAQASEKTPTTNAAAQKETLNQSGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNESQSTTSQSNDVDKSQPSVPAQKVIPNHDKAAPTSTTPPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGAELANFYTGIINDLLRVEATEGKGTQLKAS

SEQ ID NO: 31109 - protein, 203 aa, Staphylococcus aureus
  strain JKD6159
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYRVADRVYTPKRNITLNKEVVTLKELDHIIRFAHISYGLYMGEHLPKGNIVINTKDGGKYTLESHKELQKDRENVKINTDDIKNVTFELVKSVNDIEQV

SEQ ID NO: 31110 - protein, 1027 aa, Staphylococcus aureus
  strain JKD6159
MKNNLRYGIRKHKLGAASVFLGTMIVVGMGQDKEAAASEQKTTTVEENGNSATDNKVSETQTTTANVNTIEETQSYNATVTEQPSNATQVTTEEAPKAVQAPQTAQPANLETVKEEVVKEEAKPQVETTQPQDNSGNQRQVDLTPKKATQNQVTETHVEVAQPRKASESKPRVTRSADVVEAKDAKVDTGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVTANLNLNLFIDPRIVKNNGEETLTSKINGKNTEKKIEVEYKDGVGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKADGNGQNGVKVESNNLIFDEITGTGVIKGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNIGNQSFEEDTEEDKPKYEQGGNIVDIDFDSVPQIHGQNKGDQSFEEDTEKDKPKYEHGGNIIDIDFDSVPHIHGFNKHNEIIEEDTNKDKPNYQFGGHNSVDFEEDTLPKVSGQNEGQQTIEEDTTSPTPPTPEVPSEPETPTPPTPEVPSEPGEPTPPTPEVPSEPETPTPPTPEVPSEPGEPTPPTPEVPSEPGTPVPPAKEEPKKPSKPVEQGKVVTPVIEINEKVKAVAPTKQTQSKKSELPETGGEESTNKGMLFGGLFSILGLALLRRNKKNHKA

SEQ ID NO: 31111 - protein, 233 aa, Staphylococcus aureus
  strain JKD6159
MKKTIMASSLAVALGVTGYAASTGHEAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLSAWGF

SEQ ID NO: 31112 - protein, 211 aa, Staphylococcus aureus
  strain JKD6159
MKKVISLFVAILSVLIFTDNANAENNKPEGVNENSNLIPVRQPDANYPGPVSDIARVKKLDNLIDGTKDPDVIKQLKDDNEVQNNAVKANGSKIVSDCRHLLKHPDNLIDGTKDPNVINQLKNGNVTSNNGAVNPSVKANDTHTKSNKQIAKQQSNHWDSKSKSGHKQQLKELPKTGENNESNTAIMALFTGLTLLVVSFMTRFLKLNSHQ

SEQ ID NO: 31113 - protein, 925 aa, Staphylococcus aureus
  strain JKD6159
MKKRIDYLSNKQNKYSIRRFTVGTTSVIVGATILFGIGNHQAQASEQSNDTTQSSKNNASVDSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNGQVTASDFKLEKTTFDPNQSGNTFMSANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGIYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVNPKDPTPGPPVDPEPNPEPEPSPEPEPEPTPDPEPEPEPTPDPEPSPDPEPEPTPDPEPSPEPDPDSDSDSDSGSDSDSGSDSDSDSDSNSDSDSESDSDSDSDSDSDRDSDSDSDSDSDSDSDSDSDSNSDSDSDSDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKDEVNHSNKASKQHKTDALPETGDKSENTNATLFGAMMALLGSLLLFRKRKQDHKEKA

SEQ ID NO: 31114 - protein, 257 aa, Staphylococcus aureus
  strain JKD6159
MEWHIGANIMWVDCSYYVIEKSNLNRLGLKIMKFKTIAKASLALGMLATGVITSNTQSVQAKTEVKQQSESELKHYYSGPSFEHKKVTGFKYTEDGKHYLEVTVGQQHSRITLLESDKDKFKEGENSNIDVFVVREGAGRQATNYSIGGVTKTNSVQYIDYINTPILEIKKGNEDAQTIYYQIYKEDISLKELDFKLRKQLISQSGLYSNGLKQGQITITMKDGTTHTIDLSKKLEKERMGESIDGTNIEKILVEIK

SEQ ID NO: 31115 - protein, 231 aa, Staphylococcus aureus
  strain JKD6159
MKMKSIAKVSLVLGILATGVNTTTEQPVHAEKKPIVISENSKKLKSYYTQPSTEYKNTTGYISSIQPDIKFMNIIQNNTVNNLALVGKDKQHYHAGVHRNLNIFYVAEDKNFNGGKYSIGGITKASDKAVDQIAEARVIKEDHTGEYDYDFFPFKVDKEDMSLKEIDFKVRKYLIENYGLYGEMSSGSIIVQTKNYGRYTFELDKKLQEDRMSDIIDATSIERIEVKVVKA

SEQ ID NO: 31116 - protein, 281 aa, Staphylococcus aureus
  strain JKD6159
MKMTTIAKASLALGLLTAGVTTTQTANAEKASTANPEQAPKASAEKASTPSSTNIKVTQPTSTATTPSSSNVDTPQPQSTNPATPPIEINPKYKDLRAYYTKPSFEFEKQFGFMLKPWTTVRFMNIIPNRFIYKIALVGKDDKKYKDGPYDNIDVFIVLEDNKYQLKKYSVGGITKTNSKKVDHKAELNITKEDNKGKISSDVSEYKITKEEISLKELDFKLRKQLIEQHNLYGNIGSGTIVIKMKNGGKYTFELHKKLQEHRMADVIDGTNIDSIEVNIK

SEQ ID NO: 31117 - protein, 310 aa, Staphylococcus aureus
  strain JKD6159
MKMTTIAKTSLALGLLTTGVITTTTQAANATTPSSTKLETPQPTPTSTKTEQSPKANAENVLATNPEQSPKANAEKATTPASTDIKTPQSTPNATTPPSIKVETPQSPNTKQVPTEINPKYKDLRAYYTKPSLEFKNEIGIILKKWTTIRFMNIVPDYFIYKIALVGKDDKKYGEGVHRHVDAFIVLEEKNKYEVEIYSVGGITKSNSKKVDHKAGIRITKEDNKGTISHDVSEYKITKEEISLKELDFKLRKQLIEKHNLYGNVGSGKIVIKMKNGGKYTFELHKKLQEHRMADVIDGTNIDSIEVNIK

SEQ ID NO: 31118 - protein, 234 aa, Staphylococcus aureus
  strain JKD6159
MKMTAIVKASLALGILATGTITSTHQTVNASEHESKYENVTKDIFDLRDYYSGASKELKNVIGYHYSKGGRHYLVIDKNRKFTRVQIFGKDIERFKARKNPGLDIFVVKEAENRNGTVYSYGGVTKKNKGAYYDYLNAPRFQIKKDEGDGIATYDRIHYIYKEEVSLKELDFKLRQYLIQNFGLYKKFPKDSKIKVTMKDGGYYTFELNKKLQTNRMSDVIDGRNIEKIEVDIR

SEQ ID NO: 31119 - protein, 231 aa, Staphylococcus aureus
  strain JKD6159
MKLKTIAKATLALGLLATGVITTESQTVKAAESTQGQHNYKSLKYYYSKPSIELKNLDGLYRQKVTDKGVYVWKNRKDYFVGLLGKDIEKYPQGEHDKQDAFLVIEEETVNGRQYSIGGLSKTNSKEFSKEVDVKVTRKNDESSEKSKDSKFKITKEEISLKELDFKLRKKLMEEEKLYGAVNNRKGKIVVKMEDDKFYTFELTKKLQPHRMGDTIDGTKIKEINVELEYK

SEQ ID NO: 31120 - protein, 231 aa, Staphylococcus aureus
  strain JKD6159
MKLKTLAKATLALGLLTTGVITTEGQAVHAKDKQERVQHLYDIKDLHRYYSAPSFEYSNINGKVENYNGSNVVRFEQKDQNHQLFLLGKDKEEYKEGLKGQNVFVVQELIDPNGRLSTVGGVTKKNNKSSETNTHLFVNKVYGGNLDASIDSFLINKEEVSLKELDFKIRKQLVEKYGLYKGTTKYGKITINLKDEKKEVIDLGDKLQFERMGDVLNSKDIQNIAVTINQI

SEQ ID NO: 31121 - protein, 232 aa, Staphylococcus aureus
  strain JKD6159
MKLTAIAKATLVLGILTTSVITAESQTVHAKGKYEKMNRLYDTNKLHQYYSGHSYELTNVSGQSQSYYDSNVLLFNQQNQKFQVFLLGKDENKYKEKTHGLDVFAVPELVDLDGRIFSVSGITKKNVKSIFESLRTPNLLVKKIDDKDGFSIDEFFFIQKEELSLKELDFKIRKLLIKKYKLYEGAADKGRIVINMKDENKYEIDLSDKLDFERMADVINSEQIKNIEVNLK

SEQ ID NO: 31122 - protein, 227 aa, Staphylococcus aureus
  strain JKD6159
MKLTAIAKATLALGILTTGTLITEVHSGHAKQNQKSVNKHDKEALHRYYTGNFKEMKNINALKHGKNNLRFKYRGMKTQVLLPGNEYRKYQQRRYTGLDVFFVQERRDKHDISYTVGGVTKTNKTSGFVSEPRLNVTKENGKDAFVKGYPYHINKEEISLKELDFKLRKHLIEKYGLYKTISKEGRVKISLKDGSFYNLDLRYKLDFKYMGEVIDSKQIKDIEVNLK

SEQ ID NO: 31123 - protein, 231 aa, Staphylococcus aureus
  strain JKD6159
MKLKNIAKASLALGILTTGMITTTAQPVKAIEQSRLSVTSKDTQELKSYYSGTGFNFQNVSGYREENKMNVIVGQQLNVISLLGSDKERFDDGKDYNNLDVFVVREGSGKQADNISIGGITKTNENKYKDTVKHVNMFIYRNTSHNTTTVKSTFHNIYKEEISLKELDFKLRKQLIDNHDLYKTEPKDSKITVTMNNGGYYTFELNKKLQEHRMGDVIDGTKIKEINVELN

SEQ ID NO: 31124 - protein, 2150 aa, Staphylococcus aureus
  strain JKD6159
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDIVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSNSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTNIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASASKSDSQSTSISLSTSDSKSMSTSESLSDSTSTSGSVSGSLSIATSQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSTSQSDSTSISTSFSDSTSDSKSASTASSESISQSASTSTSGSMSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSTSESGSTSTSLSNSTSGSASISTSTSNSESTSMFKSESVSTSLSTSTSTSLSDSTSLSTSLSDSASGSKSNSLSASVSTSDSISTRKSESLSTSTSLSGSTSESESGSTSASESKSDSTSMSLSMSQSTSGSTSTSTSESLSDSTSTSLSLSASMNQSGVDSNSASQSASTSTSISTSESDSQSTSASLSNSQSTSTSIRMSTIASESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSGSESVSESSSLSDSISMSDSTSTSDSNSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSTSDSTSGSTSTSVSESLSTSGSGSTSVSDSTSMSESDSTSVSMSQDKSDSTSISDSESVSISTSTSLSTSDSTSTSESLSTSMSGSQSISDSTSTSMSGSTSTSESNSMHPSDSMSMHHTHSTSTSISTSESIAPNTNESQSTLSATSVSSKHDAEPAQSEERLPDTGDSIKQNGLLGGVMTLLVGLGLMKRKKKKYENDQDDSQA

SEQ ID NO: 31125 - protein, 680 aa, Staphylococcus aureus
  strain JKD6159
MKSQNKYSIRKFSVGASSILIATLLFLSGGQAQAAEKQVNMGNSQEDTVTAQSIGDQQTRGNANYQRENGVDEQQHTENLTKNLHNDKTISEKNHRKTDDLNKDQLKDDKKSSLNNKNIQRDTTKNNNANPSDVNQGLEQAINDGKQSKVASQQQSKEADNSQDSNANNNLPSQSRTKEALPLNKSNQTSQREIVNKTEIEKVQPQQNNQANDKITNYNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 31126 - protein, 1120 aa, Staphylococcus aureus
  strain JKD6159
MNNKKTATNRKGMIPNRLNKFSIRKYSVGTASILVGTTLIFGLSGHEAKAAEHTNGELNQSKNETTVPTENKTTEKVDSSQQNNIEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFKDIDIAIDKGHVNQTTGKTEFWATSSDVLKLKANYTIDDSVKEGDTFTFKYGQYFRPGSVRLPSKTQNLYNAQGNIIAKGIYDSETNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTDQNQFVDSFTPDTSKLKDVTGQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDPDSDSDSDSDSDSDSDSDSDSDSDSDSDSDSDSDSDSDSEAGKHTPAKPMSTVKDHHNKAKALPETGSENNNSNNGTLFGGLFAALGSLLLFGRRKKQNK

SEQ ID NO: 31127 - protein, 1377 aa, Staphylococcus aureus
  strain JKD6159
MLNRENKTAMTRKGMVSNRLNKFSIRKYTVGTASILVGTTLIFGLGNQEAKAAESTNKELNEATTSASDNQSNSKVDNQQLNKEDNTKNDNQKEMVSSQGSETTSNGNKSIEKESVQSTTGNKVEVSTAKSDEQASPKSTNEDLNTKQTISNQEALQSDLQENKSVVNVQPTNEENKKVDAKTESTTLNVKSDAIKSNAETLVDNNSNSNNENNADIILPKSTAPKRLNTRMRIAAVKPSSTEAKNVNDLITSNTTLTVVDADKNNKIVPAQDYLALKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQGEKGISGVTVTLKDENDKVLKTVTTDADGKYKFTDLENGTYKVEFTTPAGYTPTSTNTGGNDTVDSNGLTTTGVIKDADNMTLDSGFYKTPKYNLGNYVWEDTNKDGKQDSTEKGISGVTVTLKNENGEVLQTTKTDKDGKYQFTGLENGTYKVEFETPAGYTPTQVGSGNDESVDSNGTSTTGIIKDKDNDTIDSGFYKPKYNLGDYVWEDTNKNGIQDQGEKGISGVTVTLKDENDKVLKTVTTDADGKYKFTDLENGTYKVEFETPAGYTPTTVTSGNDTEKDSNGLTTTGVIKDADNMTLDSGFYKTPKYSLGDYVWYDSNKDGTQDSTEKGIKDVTVTLQNEKGEVIGTTKTDENGKYRFDNLDSGKYKVIFEKPAGLTQTGTNTTEDDKDADGGEVDVTITDHDDFTLDNGYFEEETSDSDSDSDSDSDSDSDSGSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDSDSDSDSDSDAGKHTPVKPMSVTKDHHNKAKALPETGSENNGSNNATLFGGLFAALGSLLLFGRRKKQNK

SEQ ID NO: 31128 - protein, 1147 aa, Staphylococcus aureus
  strain JKD6159
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTTSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTDHSTKPVATAPTSVAPKRLNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQVVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDPTEKGIKDVTVTLQNEKGEVIGTTKTDENGKYRFDNLDSGKYKVIFEKPAGLTQTGTNTTEDDKDADGGEVDVTITDHDDFTIDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31129 - protein, 434 aa, Staphylococcus aureus
  strain JKD6159
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEYGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 31130 - protein, 974 aa, Staphylococcus aureus
  strain JKD6159
MNMKKQEKHAIRKKSIGVASVLVGTLIGFGLLSSKEADASENSVTQSDSASNESKSNDPSSVNAAPKTDNTNVSDSNTTTNTNSDETNVAQNPAQQETTQSASTNATTEETPVTGEATTATNQANTPATTQSSNTNAEELVNQTSNETTSNDTNTVSSVNSPQNSTNAENVSTTQDTSTEATPSNNESAPQSKDASNKDVVNQAVNTSAPRMRAFSLAAVAADAPATGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVNTKDDVKATLTMPAYIDPENVTKTGNVTLTTGIGTNTDSKTVLIDYEKYGQFHNLSIKGTIDQIDKTNNTYRQTIYVNPSGDNVVLPALTGNLIPNTKSNALIDAKNTDIKVYRVDNANDLSESYYVNTSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSGSDSDSASDSDSDSGSDSGSDSDSASDSNSDSGSDSGSDSDSASDSDSDSGSDSGSDSDSASDSDSASDSDSASDSDSASDSDSASDSDSASDSDSASDSDSASDSDSASDSDSDSDSDSDSDSNSDSDSDSASDSDSGSDSDSDSDSDSDSDSDSDSDSDSDSDSDSDSDSDSDSDSDSDSDSDSDSDSDSDSDSDSASDSDSGSDSDSDSDSDSDSDSDSDSDSESDSDSDSDSDSDSASDSDSGSDSDSDSDSDSGSASDSSSDSDSDSDSDSDSDSDSASDSDSGSDSDSSSDSDSGSDSDSDNDYDSESDSNSDSDSGSNNNVVPPNSPKNGTNASNKNEAKDSKEPLPDTGSEGEANTSLIWGLLASLGSLLLFRRKKENKDKK

SEQ ID NO: 31131 - protein, 641 aa, Staphylococcus aureus
  strain JKD6159
MNKQQKEFKSFYSIRKSSLGVASVAISTLLLLMSNGEAQAAEETGGTNTEAQPKTEAVASPSTTTKKAPEAKSVANAVSVSNKEVEAPTPETKEAKEVKASKETKEVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKITDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAKPSKPTPSPVEKESQKQDSQKDDNKQSTSVEKENDASSESGKDKTPATKPAKAEVESSSTTPTKVVSTTQNVAQPTTASSETTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 31132 - protein, 350 aa, Staphylococcus aureus
  strain JKD6159
MTKHYLNSKYQSEQRSSAMKKITMGTASIILSSLVYIGADSQQVNAATDATNATNNQSVQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 31133 - protein, 109 aa, Staphylococcus aureus
  strain JKD6159
MKKNFIGKSILSMAAVSLTVSMFAGESHAQTKNVEAAKKYDQYQTNFKKQVNKKVMDAQKAVNLFKRTRTVATHRKAQRAVNLIHFQHSYEKKKLQRQIDLVLKYNTLK

SEQ ID NO: 31134 - protein, 165 aa, Staphylococcus aureus
  strain JKD6159
MKNKLIAKSLLAIAAIGITTTTIASTADASEGYGPREKKPVSINHNIVEYNDGTFKYQSRPKFNTTPKYIKFRHDYNIVEYNDGTFGYGPRPHFNKPAEKSVATLKKEQKLIQAQNLVREFEKTHTVSAHRKAQKAVNLVSFEYNVKKMILQERIDQVLKQGLVR

SEQ ID NO: 31135 - protein, 319 aa, Staphylococcus aureus; identical to SEQ ID NO: 30495
  strain JKD6159

SEQ ID NO: 31136 - protein, 238 aa, Staphylococcus aureus
  strain JKD6159
MRKSITNKIILTTTLLLLGTTATQTPNSPLNVSTDAKAYYIDQDETNINELIKYYTQKPLTFSNRWLYQYDDGNIYVEFKRYSWSAHIRLWGAESWGNINQLRDHYVDVFGLKDEDTRQLWWVYRDTFTGGVTPAASSSDKPYSLFVQYKDKLQTIIGAHKMYQGNKPILTLKEIDFRAREALIKNKILYHENRNKGKLKITGGGNDYTIDLSKRLHSDLANVYVKNPQKITVEVLID

SEQ ID NO: 31137 - protein, 225 aa, Staphylococcus aureus
  strain JKD6159
MIGTATSQFPHSPISMSSEAKAYNISESETNVSELTKYYTQRHLTFSNKWLWQKDNGTIHATLLQLSWFSHIQVFGPESWGNINQLRNKYVDIFALKDYETWRTYMLAQETFTGGVTPAAKPSDKHYKLNLTYKDKSGTFIGEYPFYTGNKPVLTLKEVDFRIRQTLIKNKKLYHGNYNKGHIKITGGSNNYTIDLNKRLKSTDANRYVKNPQTAHIEILLEKSN

SEQ ID NO: 31138 - protein, 241 aa, Staphylococcus aureus
  strain JKD6159
MKKNIMNKLVLSTALLLLGTTSTQLPKTPISFSSEAKAYNISENETNINELIKYYTQPHLSLSGKWLWQKPNGTIHATLQTWVWYTHIQVFGPESWGNINQLRDKYVDIFGTKDEDTVEGYWTYDETFTGGVTPAATSSDKHYKLSLKYRDKLQTMIGGLEFYQGNKPVITLKELDFRVRQTLIKNKKLYNGEFNKGQIKITGGGNNYTIDLSKKLKLTDTNRYVKNPRNTEIEIILEKSR

SEQ ID NO: 31139 - protein, 372 aa, Staphylococcus aureus
  strain JKD6159
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDIKISNTPKNSSQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31140 - protein, 325 aa, Staphylococcus aureus; identical to SEQ ID NO: 30484
  strain JKD6159

SEQ ID NO: 31141 - protein, 312 aa, Staphylococcus aureus; identical to SEQ ID NO: 30196
  strain JKD6159

SEQ ID NO: 31142 - protein, 175 aa, Staphylococcus aureus
  strain JKD6159
MLEGILTNSASAIEYSDLHHKSKLNSKRLSNAKMSFINPTQLENKKTNDRLLTHDLLFHDMFLNDASKKDFKVEFENESLSNEFINKNIDIYAGSYSYECHGGETNKTQCSYGVVTLIDNNKYDNDKNIPCNLWIDGHQTEIELTAVKTKKKIVTIQELDVQLRNYLNKKYKLYE

SEQ ID NO: 31143 - protein, 291 aa, Staphylococcus aureus; identical to SEQ ID NO: 30390
  strain JKD6159

SEQ ID NO: 31144 - protein, 893 aa, Staphylococcus aureus
  strain JKD6159
MNKHHPKLRSFYSIRKSTLGVASVIVSTLFLITSQHQAQAAENTNTSDKISENQNNNATTTQPPKDTNQTQPATQPANTAKSYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNANNQPQATTDMSQPAQPKSSVNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDIKTKDDDTSQNNTSEPLNVQTGQEDNVTATDTATNNSIETTPSEATDKVDVIEPESDMVKDTDSSVDKDAHLNIDHSSDMSGNTHFDKYDLKEMDTQIAKDTDKGVVNSVGMSSNVDTDKGSNKNKDKVIQLAHIADKNKVNNTGTETNIDTMKYHPISTIKVTDKKTTEHLPSDIHKTVDKTVKAKEKAGTPSKENKLSQSKMLPKTGETTSSQSWWGLYALLGMLALFIPKFRKESK

SEQ ID NO: 31145 - protein, 2186 aa, Staphylococcus aureus
  strain JKD6159
MNLLKKNKYSIRKYKVGIFSTLIGTVLLLSNPNGAQALTTDNNVQSDTNQATPVNSQDTNVANNRGLANSAQNTPNQSATPNQSTNQALVNHNNGSIANQATPAPIQPSASPAQNNNHSDANSTATETVSNANNNDVVSNNTTLNVPNRTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNGVTNDTIAEKTIEDGPTLRLFKVPDNVNNLKIQFVPKNDAITDTRGIYQLKDGYKYYDFVDSIGLHSGSHVYVERRTMEPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNDTLTYKTYTQDFINSPAESHTVSTNPYTIDIIMNKDALQAEVDRRIQQADYTFASLDIFNDLKRRAQTILAENRNNVPLNKRVSQADIDTLTNQMQNTLIRSVDAENAVNQKADQMEDLVNQNDELTDEEKQAAIQVIEQHKGNIIGDIGDQTTDAGVTRIKDQGIQTLSGDTATPVVKPNAKKAIRDKATKQRAIINATPDATEDEIQDALNQLTTDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQQIATINANPDATQEERQAAIDKVNAAVAAANTNILNANTNADVEQVKTNAIQGIQAIQPATKVKTDAKNAIDKSAETQHNTIFNNNDATLEEQQAAQQLLDQAVATAKQNINAADTNQEVAQAKDQGTQNIVVIQPATQVKTDARNAVNEKARETITNINATPGATREEKQEAIDRVNTLKNRALNDIGVTSTTAMVNSIRDDAINQIGAVQPHVTKKQTATGVLNDLATAKKQEINQNTNATTEEKQVALNQVDQELATAINNINQADTNAEVDQAQQAGTQAINAIQPNIIKKPAALEQIKQHYNAKLAEINQTPDATDDEKNAAINTLNQERQQAIESIKQANTNAEVDQAATVAENNIDAVQVDVVKKQAARDKITAEVAKRIEVVKQTPNATDEEKQAAVNRINQLKDQALNQINQDHTNDQVDATTNQMITAIDNVEADVVVKPKAIADIEKAFKEKQQQIDNSIDSTDNEKEVATQALAREKEKALAAIDQAQTNNQVNQAATDGLSAIKIVQPETKVKPAAREQINQKANELRAQINQDKEATAEERQAALNKINDFVNQAMSDISNDRTNQQVTDTKTQALDNIAQVNPEHIVRAAARDAVNQQYEAKKQEIEQAEHATDEEKQVALNQLTNNKERALQNINQAVTNDNVKHVETNGIATLKGVEPHIVVKPEAQQAIKASADKQVDSIKDTPDATVDELDEANQLISDTLKKAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNKAINQINHADKTAQVNQDSINAQNIISKIKPATTVKATAIQQIQNIATNKINLIKANNEATDEEQNAAIAQVEKELIKAKQQIASAVTNADVAYLLHDEKNEIREIEPVINRKASAREQLTTLFNDKKQAIEANIQATVEERDSILAQLQNIYDTAIGQIDQDRSNTQVDKTASLNLQTIHDLDVHPIKKPDAEKTINDDLARVTALVQNYRKVSDRNKADALKAITALKLQMDEELKTARTNADVDAVLKRFNVALGDIEAVITEKENSLLRIDNIAQQTYAKFKAIATPEQLAKVKVLIDQYVADGNRMIDEDATLNDIKQHTQFIVDEILAIKLPAEATKVSPKVIQSAPKVCTPIKKEETHESRKVEKELPNTGSEGMDLPLKEFALITGAALLARRRTKNEKES

SEQ ID NO: 31146 - protein, 331 aa, Staphylococcus aureus
  strain JKD6159
MSNQFKSEEERRQWEQFQAFQNQQNQQHQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNSSKSDKSSVEKSESNEETAPVEPMPQSKPTTSEASPSQNIHNEDSMYDASTE

SEQ ID NO: 31147 - protein, 807 aa, Staphylococcus aureus
  strain JKD6159
MTYKMKKWQKLSTITLLMAGVITLNGGEFRSIEKHQIAVADTNVQTPDYEKLKKTWLDVNYGYDQYDENNQDMKKKFDAKEKEAKKLLDDMKTDTNRTYLWDSAKDLDKKSADMTKTYRNIEKIAEAMRHKNTSLKTDENKLKITGAIKWLHHNVYGKDPDKKVADLTTNRKEKDSSKKNNSLNWWDYEIGTPRALTNTLLLMDDMLTKDEMKSYSKPISTYSPSSDKILSSVGESEDAKGGNLVDISKVKLLESVIEEDVDMMKKSIDSFNKVFTYVQDSATGKARNGFYKDGSYIDHQDVPYTGAYGVVLLDGISQMMPMIKESPFKHTQDKATLSNWIDEGFMPLIYKGEMMDLSRGRAISRENETSHTASATVMKSLLRLSDTMDESTKTRYKQIVKTSVKSDSSYDSNDTLTSYSDIDKMKKLMDDKTISAKEQTQQLKIYNDMDRVTYHNKDLDFAFGLSMTSKNVARYESINNENLKGWHTGAGMSYLYNSDVKHYRENFWATTDMTRLPGTTTLNDMQSTNTKNDKSFVGGTKLNNKYASIGMDFENQDKTLTAKKSYFILNDKIVFIGTGIKSTDSSKKPVTSVENRKANGYKLYKDDIEITTSDVNAQETHSVLLESSDTKKNIGYHFLDKPIITVKKETHTGKWKDINNSQSTTQKNDDYYEVTQTHNTSENKYAYVLYPGLSKSDFKSKNNNVSIVKQDEDFHVIKDNDGVFAGVNYSDSTKTFAINGATVELKEKGMFILKKKDDKTYECSFYNPESTNSASDIESKISIAGYTITNKNVTNSNDAGVNFELTK

SEQ ID NO: 31148 - protein, 484 aa, Staphylococcus aureus
  strain MRSA ST398 / isolate S0385
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDGNKPGKEDGNGIHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31149 - protein, 241 aa, Staphylococcus aureus
  strain MRSA ST398 / isolate S0385
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMLQGHMQSSNHQMMSPKANMHSSNHQMNQSNKKVLPAAGESMTSSILTASIAALLLVSGLFLAFRRRSTNK

SEQ ID NO: 31150 - protein, 645 aa, Staphylococcus aureus
  strain MRSA ST398 / isolate S0385
MLRGQEERKYSIRKYSIGVVSVLAATMFIVSSHEAQASEKTPTSNAAAQKETLNQPGEQGNAVTSHQMQSGKQLDDMHKENGKSGTVTEGKDTLQSSKHQSTQNSKTSRTQNDNQVKQDSERQGSKQSHPNNATNKTERQNDQVQNTHHAERNESQSTTSQSNDVDKSQPSVPAQKVIPNHDKAAPTSTTLPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWD

SEQ ID NO: 31151 - protein, 55 aa, Staphylococcus aureus
  strain MRSA ST398 / isolate S0385
MPKGNIVINTKNGGKYTLESHKELQKDRENVKINTADIKNVTFKLVKSVNDIEQV

SEQ ID NO: 31152 - protein, 226 aa, Staphylococcus aureus
  strain MRSA ST398 / isolate S0385
MKFKAIAKASLALGMLATGVITSNIQSVQAKTEVKQQSESELKHYYNKPVLERKNVTGYKYTEKGKDYIDVIVDNQYSQISLVGSDKDKFKDGDNSNIDVFILREGDSRQATNYSIGGVTKSNSVQYIDYINTPILEIKKGNEDVLKDLYYISKEDISLKELDYRLRERAIKQHGLYSNGLKQGQITITMKDGKSHTIDLSQKLEKERMGDSIDGTKIDRILVEIK

SEQ ID NO: 31153 - protein, 233 aa, Staphylococcus aureus
  strain MRSA ST398 / isolate S0385
MKMKSIAKVSLVLGILATGVNTVTEQPVHAENKHVQVSQNSKNLKAYYTQPSVEYKNVTGYISSIQPKPGTKFLNMIEGNTVNNLALVGKDKEHYHTGVHRNLDIFYVNEDKRFEGAKYSIGGITKASDKVVDQVAEARVIKEDHTGEYAYDFFPFKIDKEAMTLKEVDFKIRKHLIDHYGLYGEMSSGTVTVQMKYYGKYTIELDKKLQEDRMADIVKVIDIDRIEVKVKKA

SEQ ID NO: 31154 - protein, 343 aa, Staphylococcus aureus
  strain MRSA ST398 / isolate S0385
MKIRIIAKASLALGLVTTGASIVTTQSANAEVASALKAGQLAKISVSPSAITTTTQAVNAEQNRTANTEQASKSNTENVSTSPSTKTEQTPKSNIQKATQQTPSVTTTPSPNVQPQSPQPTPKPTTPPSSNVETQQPQSPTTKQAQKEINPKFKGLRSYYTKPSLEFKNELGIIIKKWTTIRFMNIVPDYFIYKIALVGKDDKKYGEGVHRHVDVFIVLEQNKYGVDKYSVGGITKANRKKVDYNARIKITKEDKKGTISHDVSEYKITKEEISLKELDFKLRKQLIEQHNLYGNIGSGTIVIKMKNGGKYTFELHKKLQQHRMADVIDGTNIDRIEVNLKSS

SEQ ID NO: 31155 - protein, 317 aa, Staphylococcus aureus
  strain MRSA ST398 / isolate S0385
MRMTQIAKASLALGLLTTGASIVTTQSAKAEVTPSLKSEQLSMISVSPSAVTTTTQGVNAEVASALKTEQAIKSNIQKVTTSHSTNAQPQSTQSTPKPTTPPSANVETPQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEEGKISRDVSEYKITKEEISLKELDFKLRKQLIEQHNLYGNIGSGTIVIKTKNGGKYTFELHKKLQEHRMADVIDGTSIDRIEVNLTSS

SEQ ID NO: 31156 - protein, 234 aa, Staphylococcus aureus
  strain MRSA ST398 / isolate S0385
MKMTAIAKASLALSILATGVITSTAQTVNASEHESKYENVTKDIFDLRDYYSRASKELKNVTGYRYSKGGKHYLIFDKHQKFTRIQIFGKDIEKLKARKNPGLDIFVVKEAENRNGTVYSYGGVTKKNKGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIEKIEANIR

SEQ ID NO: 31157 - protein, 231 aa, Staphylococcus aureus
  strain MRSA ST398 / isolate S0385
MKLKTLAKATLALGLLTTGVITSEGQAVKAAEKQERVQHLYDIKDLHRYYSAPSFEYSNISGKVENYNGSNVVRFNQKDQNHQLFLLGKDKEQYKEGLQGQNVFVVQELIDPNGRLSTVGGVTKSNNKTSETKTQLVVNKVDGGNLDASIDSFLIQKEEISLKELDFKIRKQLVENYGLYKGTSKYGKIIINLKDEKREVIDLSDKLEFERMGDVLNSKDIRGIAVTINQI

SEQ ID NO: 31158 - protein, 232 aa, Staphylococcus aureus
  strain MRSA ST398 / isolate S0385
MKLTAIAKATLALGILTTGVMTAESQTVNAKVKLDETQRKYYINMLKDYYSQESYESTNISVKSEDYYGSNVLNFNQRNKNFKVFLIGDDRNKYKELTHGRDVFAVPELIDTKGGIYTVGGITKKNVRSVFGYVSHPGLQVKKVDPKDGFSIKELFFIQKEEVSLKELDFKIRKMLVEKYRLYKGTADKGRIVINMKDEKKHEIDLSEKLSFDRMFDMLDSKQIKNIEVNLN

SEQ ID NO: 31159 - protein, 227 aa, Staphylococcus aureus
  strain MRSA ST398 / isolate S0385
MKLTALAKVTLAIGILTTGTLTTEAHSGHAKQIHKSVNKHDKEALHRYYSGNFKEMKNINALKHGKNNLRFKYRGMKTQVLLPGDEYRKYQQRRHTGLDVFFVQERRDKHDISYTVGGVTKTNKTSGFVSTPRLNVTKEKGEDAFVRGYPYDIKKEEISLKELDFKLRKHLIEKYGLYKTISKHGSVKINMKDGSFYNLNLRCKLAFKYMGEVIDSKQIKDIEVNLK

SEQ ID NO: 31160 - protein, 226 aa, Staphylococcus aureus
  strain MRSA ST398 / isolate S0385
MKLKNIAKASLALGILTTGMITTTAQPVKASTLEVRSQATQDLKGYYSGTGFNFQNVSGYRENDKMNLFSGSQLNVISLLGSDKERFKNSDYSGLDVFVVREGSGRQADNNSIGGITKTNKNNYKDFVNNVGLEITKPTGHNTATRQVETYSINKEEISLKELDFKLRKHLIDKHDLYKTEPKDSKIRVTMKNGDFYTFELNKKLQTHRMGDVIDGRNIEKIEVNL

SEQ ID NO: 31161 - protein, 798 aa, Staphylococcus aureus
  strain MRSA ST398 / isolate S0385
MNNKKTATNRKGMIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQSTKQNNDATANKDNLEAQNISTQAKDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLKEVTNQFNITYSNDNKTATVDLLNGQTSSNKQYIIQQVAYPDNTSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTVTNTTEDDKDADGGEVDVTITDHDDFTLDNGYFEEETSDSDSDSDSDSDSDSDSDSDSDSDSDSDSDAGKHTPVKPMSATKDHHNNAKALPETGSENNGSNNATLFGGLFAALGSLLLFGRRKKQNK

SEQ ID NO: 31162 - protein, 1376 aa, Staphylococcus aureus
  strain MRSA ST398 / isolate S0385
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVASEKNNNSQPSENGKLQTSDVKKTEANNTTLDDQVTTTVNSQQLNTDNTTSNATMSSAPINVSKDDLKINNEEVRNVGEKSDNADNANGSDVIMPKSTAPKRLNTRMRMAAIQSTSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPANIGQINQNVTNIKIYRVPEGYTLNKGYDVNANDLVDVTDEFKNKMTYGTNQSVNIDFGDITSAYVVMVNTKFQYTNSESPTLVQMATLSSTGNKTVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDEKGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTGKHIPVKPMSATKDHDNKAKALPETGSENNGSNNATLFGGLFAALGSLLLFGRRKKQNK

SEQ ID NO: 31163 - protein, 434 aa, Staphylococcus aureus
  strain MRSA ST398 / isolate S0385
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGKHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 31164 - protein, 608 aa, Staphylococcus aureus
  strain MRSA ST398 / isolate S0385
MNMKKQEKHAIRKKSIGVASVLVGTLIGFGLLSSKEADASENSMTQTENTRNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDTSTEVTPSNNESAPQSTDASNKDVVNQTVNTSASRMRAFSLAAADAPAVGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVDTKNDVKATLTVPAYIDPENVTKTGNVTLTTGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDQRAIRFSE

SEQ ID NO: 31165 - protein, 282 aa, Staphylococcus aureus
  strain MRSA ST398 / isolate S0385
MSDSDSASDSDSDSDSDSDSDSDSDSDSDSDSDSDSDSDSDSDSDSDSDSDSDSDSDSDSESESDSDSDSDSESDSDSDSDSESESDSDSDSDSDSDSDSDSDSDSDSDSDSDSDSDSDSDSDSDSDSASDSDSDSDSGSDSDSDSDSDSDNDSDSDSDSDSASDSDSGSDSDSSSDSDSDSASDSDSDSDSTSDTGSDNDSDSESDSNSDSESGSNNNVVPPNSPKNGTNASNKNEAKDSKEPLPDTGSEDEANTSLIWGLLASLGSLLLFRRKKENKDKK

SEQ ID NO: 31166 - protein, 639 aa, Staphylococcus aureus
  strain MRSA ST398 / isolate S0385
MNKQQKEFKSFYSIRKSSLGVASVAISTLLLLMSNGEAKAAEETGGTNTEAQPKTEAVASPTTTTTEKAPEAKPVANAVSVANKEVVAPTTETKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSASVEKENDASSESAKDKTPATKPAKAEVESSSTTPTKVVSTTQNVAKPTTASSETTKDVVQTSAGSSEAKDSAPLQKANIKNTNDGDTQSQNNKNTQENKAKSLPQTGEESNKDMTLPLMALLALSSIVAFVLPRKRKN

SEQ ID NO: 31167 - protein, 354 aa, Staphylococcus aureus
  strain MRSA ST398 / isolate S0385
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPGQPKTPTEQTKPVQPKVEKVKPAVTAPSKAENTQTTKVVSTEATKDQSQTQSARTVKTTQTAQEQNKVQTPVKDVATAKSESNNQAVSDNKSQQTNKVTKQNEVHKQGPSKDSKAKELPKTGLTSVDNFISTVAFATLALLGSLSLLLFKRKESK

SEQ ID NO: 31168 - protein, 105 aa, Staphylococcus aureus
  strain MRSA ST398 / isolate S0385
MKKNFIGKSILSIAAISLTVSTFAGESHAQTKAEKYNEYQTNFKKQVNKKVVDAQKAVNLFKRTRTVATHRKAQRAVNLIHFQHSYEKKKLQRQIDLVLKYNTLK

SEQ ID NO: 31169 - protein, 165 aa, Staphylococcus aureus
  strain MRSA ST398 / isolate S0385
MKNKLIAKSLLTIASIGITTTTLASTADASEGYGPREKKPISINNNIVEYNDGTYKYQSRPKFNTTPKYIKFRHDYNIVEYNDGTFEYGARPQFNKPAAKTEATIKKEQKLIQAQNLVREFEKTHTVSAHRKAQKAVNLVSFEYNVKKMILQERIDQVLKQGLVR

SEQ ID NO: 31170 - protein, 319 aa, Staphylococcus aureus
  strain MRSA ST398 / isolate S0385
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLSDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 31171 - protein, 238 aa, Staphylococcus aureus
  strain MRSA ST398 / isolate S0385
MRKRIMKKLIFMTTLLLLGTTATQTPNSPLNVSTDAKAYHIGQDETNINELIKYYTQPPLTFSNRWLYQYDDGNIYVEFKRYSWSAHIRLWGAESWGNVNQLRDRYVDVFGLKDEDTSQLWWVYRDTFTGGVTPAASPSDKPYSLFVQYKDKLQTIIGAHKMYQGNKPILTLKEIDFRARETLIKNKILYHENRNKGKLKIIGGGNDFTIDLSKRLHSDLANVYVKNPQKITVEVLID

SEQ ID NO: 31172 - protein, 241 aa, Staphylococcus aureus
  strain MRSA ST398 / isolate S0385
MKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPAAKPSDKYYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKPS

SEQ ID NO: 31173 - protein, 241 aa, Staphylococcus aureus
  strain MRSA ST398 / isolate S0385
MKKNITNKIVLSTALLLLGTTSTQPPKAPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNRYVKNPRHAEIEVILEKSH

SEQ ID NO: 31174 - protein, 70 aa, Staphylococcus aureus
  strain MRSA ST398 / isolate S0385
MNKQQSKVRYSIRKVSIGTFLNGDYDGKLMKFQSLDQNWNNGGWRKAEVAHKVVHNYENDMIFIRPLKKA

SEQ ID NO: 31175 - protein, 250 aa, Staphylococcus aureus
  strain MRSA ST398 / isolate S0385
MGEFEVKYLTGFILILLLEGIFTNSASAIEYSDLHHKSKLDSKRLYNAKVSFANPTDLENKKTNDRLLKHDLLFHDMFVNDDWKKDFKVEFENEALSKKFINKDIDIFAGNYGYGCHGGEANKTQCSYGGVTFSDNNKYDDYKNIPCNLWIDGHQTEIELTAVKTKKKIVTIQELDVQLRNYLNEKYKLYEQGGDIVKGYVKYHNDDEKNVEYDFYNLNGEYGHEVLKMYADNKTINSDKLHLDIYLFKS

SEQ ID NO: 31176 - protein, 291 aa, Staphylococcus aureus; identical to SEQ ID NO: 30390
  strain MRSA ST398 / isolate S0385

SEQ ID NO: 31177 - protein, 895 aa, Staphylococcus aureus
  strain MRSA ST398 / isolate S0385
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVASNDQSSSDASNQTNTNTSNQNTSTTNNASDQPQATTNMSQPAKPVSSANADQASSQPAHETNSNGNTNDKTNASSNQSNGNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYVSDKAIYNAIVKVVVANIGYEGQYHVRIVNQDIKTKDDDTSQNNTSEPLNVQTGQENKVSATDTAENSSTATNPKDASDKADVIEPESDVVKVTDSNIDKDAHHDVDHLSDMSDNTHLDKYDLKEMDTQIAKDTDKGVDKDADNSVGMSSNVDTEKDINKNEGKVIQLAHNTDKNNHTGKAAKLDGVRQNYNNIDKVTDKKTTEHPSNDIHKTVDKTVKTKEKSGTPSKENKLSQSKMLPKTGETTSSQTWWGLYALLGMLALFIPKFRKEPK

SEQ ID NO: 31178 - protein, 2182 aa, Staphylococcus aureus
  strain MRSA ST398 / isolate S0385
MNLLKKNKYSIRKYKVGIFSTLIGTVLLLSNPNGAQALTTDHNVQGGSNQALPGNSPNTNADTNRDIVNGSQNTPNAHATDNTSTNQALTNHQNVGVANQVAPAPIQPSTSSASNNNHSDANSTATEPAANTNNNLASNNNTLNVPNNTDNNDSARHLTLKEIQEDVRHSSDKPELVAIAEEASNRPKKRSRRAAPADPNATPADPTAGNGSAPVAITAPFTPTTDPNANNIGQNAPNEVLTFDDNNIRPSTNRSVPTVTVVDNLPGYTLINGGKVGVFSHAMVRTSMFDSGDAKNYQAQGNVIALGRIKGNDTNDHGGFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDILTYKTYTQDFINSPAESHTVSTNPYTIDIIMNKDALQAEVDRRIQQADYTFASLDIFNELKRRAQTILDENRNNVPLNKRVSQADIDSLVNQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAAANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALNDIGVTSTTAMVNSIRDDAVNQIGAVQPHVTKKQTATGVLTDLATAKKQEINQNTNATDEEKQVALNQVDQDLATAINNINQADTNAEVDQAQQLGTKAINAIQPNIVKKPTALAQINQHYNAKLAEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAKVVIKPKAIADIEKAVKEKQQQIDNSLDSTDNEKEVALLALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQALDDIALVTPDHIVRATARDAVKQQYEAKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIASAVTNADVAYLLHDGKNEIREIEPVINKKATAREQLTTLFNDKKLAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGIRMIDEDATLNDIKQHTQFIVDEILAIKLPAEATKVLPKVGQPAPKLCTSIKKVDKQEVRKVVKELPNTGSEEMDLPLKELALITGAALLARRRNKNEKES

SEQ ID NO: 31179 - protein, 331 aa, Staphylococcus aureus
  strain MRSA ST398 / isolate S0385
MSNQFKSEEERRQWEQFQAFQNQQNQQHQQYGQKKSKKGWFWGCGGCLVLFILIIIGISACTAGVTGNLGGNSSKETNKTHKIGETVKNGDLEVTVNSVETMKSVGPSLAPTNAKGIFVVADVTIKNKGKEALTIDSSMFKLKSGDKTFEADNTGSMSANQNDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMRQSKPTTSEAPPSQNIHNEDSMYDASTE

SEQ ID NO: 31180 - protein, 807 aa, Staphylococcus aureus
  strain MRSA ST398 / isolate S0385
MTYKMKKWQKLSTITLLMAGVITLNNGEFRNVDKHQIAVADTNVQTPDYEKLKKTWLDVNYGYDQYDENNQDMKKKFDAKEKEAKKLLEDMKTDTNRTYLWDSAKDLDKKSADMTKTYRNIEKIAEAMRHKNTSLKTDENKLKITDAIKWLHHNVYGKDPDKKVTDLTTNRKEKDSSKKNNSLNWWDYEIGTPRALTNTLLLMDDMLTKDEMKNYSKPISTYAPSSDKILSSVGESEDAKGGNLVDISKVKLLESVIEEDETMMKNSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDDSTKAKYKQIVKTSVNSDSSYNQNDYLNSYSDIDKMKKLMDDSTISKNDLTQQLKIYNDMDRVTYHNKDLDFAFGLSMTSKNVARYESINNENLKGWHTGAGMSYLYNSDVKHYRDNFWATADMTCLPGTTTLNDMPSTNTKNDKSFVGGTKLNNKYASIGMDFENQDKTLTAKKSYFILNDKIVFIGTGIKSTDSSKNPVTSVENRKAVGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDNNTYECSFYNPTSTNSTSNKESKISVTGYTITNQSVSNFKESDIHFELTK

SEQ ID NO: 31181 - protein, 689 aa, Staphylococcus aureus
  strain MRSA ST398 / isolate S0385
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDSKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKAKAERYVPYSIAVNGTSTPNLSDLKFKGDSRVSYSDITKKVKSVLKHDRGIGERELKYAKKATYTVHFKNGTKKVINLNSKISQLNLLFVKDIKKIDVDVKTGSKAKADSYVPYTIAVNGTSTPIASKLKLSNKQLIGYQDLNKKVKSVLKHDRGINDIELKFAKQAKYTVHFKNGKTQVVDLKSDIFTRNLFSVKDIKKIDIDVKQHTKSNKALNKVANIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 31182 - protein, 330 aa, Staphylococcus aureus
  strain MRSA ST398 / isolate S0385
MVKKTKSNTLKKAATLALANLLLIGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 31183 - protein, 338 aa, Staphylococcus aureus
  strain MRSA ST398 / isolate S0385
MIKQVCKNITACSLALSTALTVFPASSYAKINSEIKQVSEKNLDGETKMYTRTATTSDSQKNITQSLQFNFLTEPNYDKETVFIKAKGTIGSGLRILEPNGYWNSTLRWPGSYSVSIQNVDDNNNTNVTDFAPKNQDESREVKYTYGYKTGGDFSINRGGLTGNITKESNYSESISYQQPSYRTLLDQSTSNKGVGWKVEAHSINNMGHDHTRQLTNDSDDRVKSEIFSLTRNGNLWAKDNFTPKDKMPVTVSEGFNPEFLAVMSHDKKDEGKSKFVVHYKRSMDEFKIDWNKHGFWGYWSGENHVDKKEEKLSALYEVDWKTHNVRFIKVLNDKEQK

SEQ ID NO: 31184 - protein, 351 aa, Staphylococcus aureus
  strain MRSA ST398 / isolate S0385
MKNKKRVFIASSLSCALLLLSAANTEANSANKDSQDQTKKEHVDKAQQKEKRNVNDKDKNTPGPDDIGKNGKVTKRTETVYDEKTNILQNLQFDFIDDPTYDKNVLLVKKQGSIHSNLKFESHKEENNSSWLKYPSEYHVDFQVKSNRKTEILDQLPKNKISTAKVDSTFSYNSGGKFDSVKGVGRTSSNSYSKTISYNQQNYDTIASGKNNNWHVHWSVVANDLKYGGEVKNRNDDFLFYRNTRLSTVENPELSFASKYRYPALVRSGFNPEFLTYLSNEKSNEKTQFEVTYTRNQDVLKNKPGIHYAPPILEKNKDGQRLIVTYEVDWKNKTVKVIDKYSDENKPYKEG

SEQ ID NO: 31185 - protein, 44 aa, Staphylococcus aureus; identical to SEQ ID NO: 30513
  strain MRSA ST398 / isolate S0385

SEQ ID NO: 31186 - protein, 231 aa, Staphylococcus aureus; identical to SEQ ID NO: 30654
  strain MRSA ST398 / isolate S0385

SEQ ID NO: 31187 - protein, 2453 aa, Staphylococcus aureus
  strain MRSA ST398 / isolate S0385
MNLFRQQKFSIRKFNVGIFSALIATVTFISINPTTASAAEQNQPAQNQPAQPADASAQPNANAGAQANPTAQPAAPANQGQPAAQPANQGGQANPAGGAAQPAAGTTQPAGQGNQADPNNAAQAQPGNQAGQGNNQATPNNNATPANQTQPANAPAAAQPAAPVAANAQTQDPNASNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEIFKIENITDSTQTKMDAYKEVKQAATARKAQNATVSNATDEEVAEADAAVDAAQTEGLHDIQVVKSQQEVADTKAKVLDKINAIQTQARVKPAADTEVENAYNTRKQEIQNSNASTTEEKQAAYTELDTKKQEARTNLDTANSNSEVATAKDNSIAAINQVQAATTKKSDAKAEIAQKASERKTAIEAMNDSTTEEQQAAKDKVDQAVVNANADIDNAAANNDVDNAKTTNEATIAAITPDANVKPQAKQAIADKVQAQETAIDANNGATTEEKTAAKQQVQTEKTTADAAIDGAHSNAEVEAAKNAEIAKIEAIQPATTTKDDAKQAIATKANERKAAIAQTQEITAEEIAAANANVDNAVTEANNHIETANSQNEVDQAKTTGEASIDQVTPTVNKKATARNEITTILNNKLQAIQATPDATDEEKQAAETEANTENAKANQAITAATTNAEVDEAKTNAEAAINAVTPKVMKKQAAKDEIDQLQAAQTAVINNDQNATNEEKEAAIQQLATAVTDAKNNITAATDNNGVDTAKDAGKNSIQSTQPATAVKSNAKNEVDQAVTTQNQAIDNTTGATTEEKNAAKDLVSKAKEKAYQDILNAQTTNDVTQIKDQAVADIQGITADTTIKDVAKDELATKAKEQKALIAQTADATTEEKEQANQQVDAQLTQGNQNIENAQSIDDVNTAKDNAIQAIDPIQASTDVKTNARAELLNEMQNKITEILNDNTTTNEEKGKDIEPVRAAYEEGLNNINAATTTGDVTTAKDTAVQKVQQLHANPVKKPAGKTELDQAAADKKTQIEQTPNASQQEINDAKQEVDAALNQAKTNIDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNILADTNATQDEKQQAIKQVDQNVQTALESINNGVDNSDVDDALTQGKAAIDAIQVDATVKPKANQAIDDKAQETKESIDQSDQLTAEEKTAALATIKQITDQAKQGITDATTTAEVEKAKAQGLEAFDNIQIDSTEKQKAIEELETSLDQIEAGVNVNVDATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNAEVDELQNVTIPAIEAIVPQKDPNANDTNSGSDNNDATANSNANATPENTGQPNVTESTDNANADTSSTTTNNQNDAATGGTTATSTNNSSVDASTDNSATGNGTTDKPATETDNATPAEGTRNNNGTATATNENAPTGSTATAPTTNASTGAASSADSKDNASVNDSKQNAEVNNSAESQSTNGKVAQPKSENKAKAEKDGRDSTNQSMVESTTETLPSADITGPKVPSNTEKDKEESTTNQTDAGQLKSETNVASNEADKSEGNVDTDVSNKPSTSASSEAKEKMTSINVSQKDDTATADTNDTQTSVGPVANNKATQNDGTNASPATVSNGSNSANQDMLNVTNTEENKANAKSAQQGKVNKLKQQAKTLPDTGMSHNDDLPYAELALGAGMAFLIRRFTKKDQQTEE

SEQ ID NO: 31188 - protein, 809 aa, Staphylococcus aureus
  strain MRSA ST398 / isolate S0385
MTYRMKKWQKLSTITLLMAGVITLNGGEFRSVDKHQIAVADTNVQTPDYEKLRNTWLDVNYGYNKYDENNDAMKKKFEATEKEAEKLLSSMKTESGRTYLWAGAENLETNSSHMTRTYRNIEKIAEAMKHKNTKLKTDENKTKVKDALEWLHENAYGKEPDKKVADLKTNFSKSAPQKNTNLNWWDYEIGTPRALTNTLILLNGDISSDEKKKYTAPIKTFAPKSDEILSSVGKAEPAKGGNLVDISKVKLLESIIEEDTTMMKESIVAFNKVFTYVQSNATDKERNGFYKDGSYIDHKDVPYTGAYGVVLLEGISQMMPMIKETPFNDKTQNNTTLKSWIDDGFLPLIYKGEMMDLSRGRAISRENETSHTASATVMKSLLRLSDTMDDSTKTKYKQIIKTSVKSDSSYNQNDYLNSYSDIDKMKKLIDDKSITTNDLTQQLKIYNDMDRVTYHNKDLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNKPKITVTKETHTGNWKEINKSQKDTQKTDEYYEVTQKHSNSDNKYGYVLYPGLSKDVFKSKASQVTVVKQDDDFHVVKDNESVWAGVNYSDSTQNFEINGTKVEVKAKGMFILKKKDDNTYECSFYNPESTNSASDIESKISMTGYSITNKNTSTTNESGVRFELTK

SEQ ID NO: 31189 - protein, 141 aa, Staphylococcus aureus
  strain MRSA ST398 / isolate S0385
MKLKSFVTATLALGLLSTVGAALPSHEASADSNNGYKEMTMDGYHTVPYTISVDGITALHRTYFVFPENKKVLYQEIDSKVKNELASQRGVTTEKINNAQTATYTLTLNDGNKKVVNLKKNDDAKNSIDPSTIKQIQIVVK

SEQ ID NO: 31190 - protein, 321 aa, Staphylococcus aureus
  strain MRSA ST398 / isolate S0385
MNLKLNRKKVISMIKNKILTATLAVGLIAPLANPFTEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 31191 - protein, 315 aa, Staphylococcus aureus
  strain MRSA ST398 / isolate S0385
MLKNKILATTLSVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 31192 - protein, 325 aa, Staphylococcus aureus; identical to SEQ ID NO: 30479
  strain MRSA ST398 / isolate S0385

SEQ ID NO: 31193 - protein, 443 aa, Staphylococcus aureus
  strain MRSA ST398 / isolate S0385
MTGTVEESDDSKPIDFEYHTAVEGAEGHAEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPGEPTPPTPEVPSEPETPVPPTPEVPSEPGKPVPPAKEEPKKPSKPVEQGKVVTPVIEINEKVKAVAPTKQKQSKKSELPETGGEESTNKGILFGGLFSILGLALLRRNKKNHKA

SEQ ID NO: 31194 - protein, 994 aa, Staphylococcus aureus
  strain MRSA ST398 / isolate S0385
MIVVGMGQDKEAAASEQKTTTVEENGNSATENKTSETQTTATNVNHIEETQSYNATVTEQPSNATQVTTEEAPKAVQAPQTAQPANVETVKEEVVKEEAKPQVKETTQSQDNSGDQRQVDLTPKKATQNQAAETQVEVAQPRTVSESKPRVTRSADVVEAKEASDASEIKGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVIANLNLNLFIDPRIVKNNGEETLTSKLNGKNTEKKIEVEYKDGVGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKADGNGQNGVKVESNNLIFDEVTGTGVITGQYDKNLVTTVEEETDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPGEPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 31195 - protein, 233 aa, Staphylococcus aureus
  strain MRSA ST398 / isolate S0385
MKKTIMASSLAVALGVTGYAASTGHEAHAAEVNVDQAHLVDLAHNHQDQLNAAPIKDGAYDIHFVKDGFQYNFTSNGTTWSWSYEAANGQTAGFSNVAGADYTTSYNQGSDVQSVSYNAQSSNSNVAAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLSAWGF

SEQ ID NO: 31196 - protein, 720 aa, Staphylococcus aureus
  strain MRSA ST398 / isolate S0385
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTKDANSIATNSELKNPQTLDLPQSSPQTISNAQGTSKPSVRTRAVRSLTVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPDPEPSPEPEPEPTPDPEPSPDPDPDSDSDSDSGSDSDSDSDSDSDSDSDSDSDSDSESDSDSDSESDSESDSDSDSDSDSDSDSDSDSDSDSNSDSESDSDSDSDSDSDSDSDSDSDSDSDSDSDSGLRQ

SEQ ID NO: 31197 - protein, 2279 aa, Staphylococcus aureus
  strain MRSA ST398 / isolate S0385
MSKRQKEFHDSLANEKTRVRLYKSGKNWVKSGIKEIEMFKIMGLPFISHSIVSQDNQSISKKMTGYGLKTTAVIGGAFTINMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQRTNISTNQSTASNTTSQSTAPAPTHLKQTSTTSTSTAPVKLRTFSRLAMSTFASTATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNVSAKAKADPPSVAGGGAFGAFVTTDSTGVASTYTSSSIADNAAKLNIQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQTNNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESQSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSGSVSGSLSIATSQSVSTSTSDSMSTSEIVSDSISTSGSLAASDSKSMSVSSSMSTSQSGSTSESLSDSISTSDSDSKSLSLSTSQSGSTSTSTSTSSSVRMSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSSSTSASTSLSDSNSESGSTSTSLSNSTSSSTSISTSTSGSASTSAYKSESVSTSLSTSTSTSLSDSTSLSTSLSDSASGSKSNSLSASMSTSDSISTRKSESLSTSTSLSGSTSESESGSTSSSESKSDSTSMSLSMSQSTSGSTSVSTSESLSDSTSTSLSLSASMNQSGIDSNSASQSVSASTSTSTSESDSQSTSSYTSQSTSQSESTSTSMSLSDSTSMSRSTSQSGSTSTSASLSGSESESDSQSISTSASESTSESTSTSLSDSESTSNSTSESTSNAISTSASASESDSSSTSLSDSTSASMQSSESDSQSTSTSLSNSQSTSTSNRMSTITSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSVSISDSQSMSESVNYSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESSSLSDSISMSDSTSTSESDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSDSTSGSTSTSTSESLSMSGSDSTSVSDSTSMSESDSTSVSMSLSTSDSTSISDSESVSTSTSMSLSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 31198 - protein, 681 aa, Staphylococcus aureus
  strain MRSA ST398 / isolate S0385
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDSNANNNLPSQSRTKVAPSLNKSDQTSQREIVNETEIEKVQPQQKNQSNDKMTSHHFNNEQEVNPQKDEKTLSVSDLKNNQKSPVEPTKNNDKKKGLNLLKSSAVATLPNKGTKELTAKATGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 31199 - protein, 1183 aa, Staphylococcus aureus
  strain MRSA ST398 / isolate S0385
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSDYYSGPNAITDFEKAFPGSKITVDNTKNTIDVTIPQGYGSLNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIKTDANGIANIKALPSGDYILKEIEAPAPYIFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDATPEGYTKKENGLVVTNTEKPIETTSISGEKVWDDKDNQDGKRPEKVSVNLLANGEKVKTLDVTSETNWKYEFKNLPKYDEGKKIEYTVTEDHVKDYTTDINGTIITNKYTPGETSATVTKNWDDNNNQDGKRPTEIKVELYQDGKATGKTATLNESNNWTHTWTGLDEKAKNQQVKYTVEELTKVKGYTTHVDNNDIGNLIVTNKYTPETTSISGEKVWDDKDNQDGKRPEKVSVNLLANGEKVKTLDVTSETNWKYEFKNLPKYDEGKKIEYTVTEDHVKDYTTDINGTIITNKYTPGETSATVTKNWDDNNNQDGKRPTEIKVELYQDGKATGKTATLNESNNWTHTWTGLDEKAKNQQVKYTVEELTKVKGYTTHVDNNDIGNLIVTNKYTPETTSISGEKVWDDKDNQDGKRPEKVSVNLLANGEKVKTLDVTSETNWKYEFKNLPKYDEGKKIEYTVTEDHVKDYTTDINGTIITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31200 - protein, 1183 aa, Staphylococcus aureus
  strain MRSA252
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATVKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31201 - protein, 680 aa, Staphylococcus aureus
  strain MRSA252
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 31202 - protein, 290 aa, Staphylococcus aureus
  strain MRSA252
MKYRKLIILVLSILIILPVSTLDGHHIANADDDPPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDMHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKD

SEQ ID NO: 31203 - protein, 1351 aa, Staphylococcus aureus
  strain MRSA252
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 31204 - protein, 175 aa, Staphylococcus aureus
  strain MRSA252
MNQTTKLCAATTLALGTLIGATVVGTASPIHQEAQAATTPYYTYHGYIGHNANFIMDKHFINAIKYDNVTFNGIKLAKTNATKKVEKYDQTFKGVTAKGNEANQLQFIVKNNISLKDIQKAYGKDLKKENNKTKESDSGIFYYQHSKKSLGIWFVVDHNRVVEVTVGHTPYKTSK

SEQ ID NO: 31205 - protein, 873 aa, Staphylococcus aureus
  strain MRSA252
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 31206 - protein, 233 aa, Staphylococcus aureus; identical to SEQ ID NO: 31039
  strain MRSA252

SEQ ID NO: 31207 - protein, 255 aa, Staphylococcus aureus
  strain MRSA252
MKKIVTATIATAGLATIAFAGHDAQAAEQNNNGYNSNDAQSYSYTYTIDAQGNYHYTWTGNWNPSQLTQNNTYYYNNYNTYSYNNASYNNYYNHSYQYNNYTNNSQTATNNYYTGGSGASYSTTSNNVHVTTTAAPSSNGRSISNGYASGSNLYTSGQCTYYVFDRVGGKIGSTWGNASNWASAAASSGYTVNNTPKAGAIMQTTQGYYGHVAYVEGVNSNGSVRVSEMNYGHGAGVVTSRTISANQAGSYNFIH

SEQ ID NO: 31208 - protein, 965 aa, Staphylococcus aureus
  strain MRSA252
MKNNLRYGIRKHKLGAASVFLGTMIVIGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 31209 - protein, 325 aa, Staphylococcus aureus; identical to SEQ ID NO: 30479
  strain MRSA252

SEQ ID NO: 31210 - protein, 315 aa, Staphylococcus aureus; identical to SEQ ID NO: 31191
  strain MRSA252

SEQ ID NO: 31211 - protein, 309 aa, Staphylococcus aureus
  strain MRSA252
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDTTYAYVTRHRLAVDRKHDAFKNRNVTVKYEVNWKTHEVKIKSITPK

SEQ ID NO: 31212 - protein, 437 aa, Staphylococcus aureus
  strain MRSA252
MKNKYISKLLVGAATITLATMISNGEAKASENTQQTSTKHQTTQNNYVTDQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNEKDSIENRRLAQREVNKAPMDVQKHLQKQLDALVAQKDAEKKVAPKVEAPQIQSPQIEKPKAESPKVEVPQIQSPKVEVPQSKLLGYYQSLKDSFNYGYKYLTDTYKSYKEKYDTAKYYYNKYYQYKGLIDKTVLTTIGSGYGSYIKPLEVSKESGNLAKSYAQVRNYVTESINTGKVLYAFYQKPELVKTAIKAQETATTFKNALTGIFKSFWK

SEQ ID NO: 31213 - protein, 269 aa, Staphylococcus aureus
  strain MRSA252
MKKIATATIATAGFATIAIASGNQAHASEQDNYGYNPNDPTSYSYTYTIDAQGNYHYTWKGNWHPSQLNQDNGYYSYYYYNGYNNYSYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNNNGSVRVSEMNYGYGPGVVTSRTISASQAAGYNFIH

SEQ ID NO: 31214 - protein, 141 aa, Staphylococcus aureus
  strain MRSA252
MKLKSFVTATLALGLLSTVGAALPSHEASADSNNGYKEMTMDGYHTVPYTISVDGITALHRTYFVFPENKKVLYQEIDSKVKNQLASQRGVTTEKINNAQTATYTLTLNDGNKKVVNLKKNDDAKNSIDPSTIKQIQIVVK

SEQ ID NO: 31215 - protein, 808 aa, Staphylococcus aureus
  strain MRSA252
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSDISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 31216 - protein, 231 aa, Staphylococcus aureus
  strain MRSA252
MKKTLLASSLAVGLGIVAGNAGHEAQASEADLNKASLAQMAQSNDQTLNQKPIEAGAYNYTFDYEGFTYHFESDGTHFAWNYHATGANGADMSAQAPATNNVAPSADQSNQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 31217 - protein, 26 aa, Staphylococcus aureus
  strain MRSA252
MAQDIISTIGDLVKWIIDTVNKFTKK

SEQ ID NO: 31218 - protein, 351 aa, Staphylococcus aureus
  strain MRSA252
MKNKKRVFIASSLSCVLLLLSAANTEANSANKDSQDQTKKEHVDKAQQKEKRNVNDKDKNTPGPDDIGKNGKVTKRTVSEYDKETNILQNLQFDFIDDPTYDKNVLLVKKQGSIHSNLKFESHRNETNASWLKYPSEYHVDFQVQRNPKTEILDQLPKNKISTAKVDSTFSYSLGGKFDSTKGIGRTSSNSYSKSISYNQQNYDTIASGKNNNRHVHWSVVANDLKYGNEIKNRNDEFLFYRNTRLSTVENPELSFASKYRYPALVRSGFNPEFLTYISNEKSNEKTRFEVTYTRNQDILKNKPGIHYGQPILEQNKDGQRFIVVYEVDWKNKTVKVVEKYSDQNKPYKEG

SEQ ID NO: 31219 - protein, 339 aa, Staphylococcus aureus
  strain MRSA252
MIKQVCKNITICSLALSTALTVFPASSYAEIKSKITTVSEKNLDGDTKMYTRTATTSDTEKKISQSLQFNFLTEPNYDKETVFIKAKGTIGSGLKILNPNGYWNSTLRWPGSYSVSIQNVDDNNNSTNVTDFAPKNQDESREVKYTYGYKTGGDFSINRGGLTGNITKEKNYSETISYQQPSYRTLIDQPTTNKGVAWKVEAHSINNMGHDHTRQLTNDSDDRVKSEIFSLTRNGNLWAKDNFTPKNKMPVTVSEGFNPEFLAVMSHDKNDKGKSRFIVHYKRSMDDFKLDWNKHGFWGYWSGENHVDQKEEKLSALYEVDWKTHDVKLIKTINDKEQK

SEQ ID NO: 31220 - protein, 257 aa, Staphylococcus aureus
  strain MRSA252
MKKTAFILLLFIALTWTTSPLVNGSEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 31221 - protein, 163 aa, Staphylococcus aureus
  strain MRSA252
MLKRGLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVIIEKK

SEQ ID NO: 31222 - protein, 149 aa, Staphylococcus aureus [sequence omitted]

SEQ ID NO: 31223 - protein, 116 aa, Staphylococcus aureus
  strain MRSA252
MKIRKSILAGTLAIVLASPLVTNLDKNEAQASTSLPTSNEYQNEKLANELKSLLDELNVNELATGSLNTYYKRTIKISGQKAMYALKSKDFKKMSEAKYQLQKIYNEIDEALKSKY

SEQ ID NO: 31224 - protein, 689 aa, Staphylococcus aureus
  strain MRSA252
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKANAERYVPYTIAVNGTSTPNLSDLKFKGDSRVSYSDITKKVKSVLKYDRGIGERELKYAKKATYTVHFKNGTKKVINLNSKISQLNLLFVKDIKKIDVDVKTGSKAKADSYVPYTIAVNGTSTPIASKLKLSNKQLIGYQDLNKKVKSVLKHDRGINDIELKFAKQAKYTVHFKNGKTQVVDLKSDIFTRNLFSVKDIKKIDIDVKQHTKSNKALNKVSNIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 31225 - protein, 388 aa, Staphylococcus aureus
  strain MRSA252
MKRNFPKLIALSLIFSLSITPIANAESNSNIKAKDKRHVQVNVEDKSVPTDVRNLAQKDYLSYVTSLDKIYNKEKASYTLGEPFKIYKFNKKSDGNYYFPVLNTEGNIDYIVTISPKVTKDSSSSSKYTINVSSFLSKALNEYKDQQITILTNSKGYYVVTQNHKAKLVLKTPRLEDKKAKKTESIPTGNNVTQLKQKASVTMPTSQFKSNNYTYNEQYVNKLENFKIRETQGNNGWCAGYTMSALLNATYNTNKYHAEAVMRFLHPNLQGQQFQFTGLTPREMIYFGQTQGRSPQLLNRMTTYNEVDNLTKNNKGIAILGSRVESRNGMHAGHAMAVVGNAKLNNGQEVIIIWNPWDNGFMTQDAKNNVIPVSNGDHYQWYSSIYGY

SEQ ID NO: 31226 - protein, 254 aa, Staphylococcus aureus
  strain MRSA252
MLNVLLLIINLIAICSVNNAYANEENPKIEDLCKKSSVDDIALHNIDKDYMTNRFTINESTVLTTEKFLDIDLLFKNFTWLDGKSAEFKDLKVEFSSSEISKEYFGKTVDIYGVYYKAHCHGEHQVKTACTYGGVTPHENNKLSEPKEIGVAVYKDNVNVNTFIVTTDKKKVTAQELDIKVRTKLNNVYKLYDRMTSDVQKGYIKFHSHSEHKESFYYDLFYIKGNLPDQYLQIYNDNKTIDSSDYHIDVYLFT

SEQ ID NO: 31227 - protein, 239 aa, Staphylococcus aureus; identical to SEQ ID NO: 30171
  strain MRSA252

SEQ ID NO: 31228 - protein, 242 aa, Staphylococcus aureus; identical to SEQ ID NO: 30522
  strain MRSA252

SEQ ID NO: 31229 - protein, 261 aa, Staphylococcus aureus; identical to SEQ ID NO: 30506
  strain MRSA252

SEQ ID NO: 31230 - protein, 251 aa, Staphylococcus aureus; identical to SEQ ID NO: 30505
  strain MRSA252

SEQ ID NO: 31231 - protein, 258 aa, Staphylococcus aureus; identical to SEQ ID NO: 30518
  strain MRSA252

SEQ ID NO: 31232 - protein, 239 aa, Staphylococcus aureus
  strain MRSA252
MNKNLVIKSMAALAILTSVTGISAAVVEETQQIAKAEKHVTQVKDTNVFPYHGVVAFKDATGFVIGKNTIITNKHVSKDYKVGDRITAHPNGDKGNGGIYKIKSISDYPGNEDISVMNIEEQAVERGSNGFNFNDNVQAFKFAKDAKVDDKIKVIGYPLPAQNSFKQFESTGTIKRIKDNILNFDAYIEPGNSGSPVLNSNNEVIGVVYGGIGKVGSEYNGAVYFTPQIKDFIQKHIEQ

SEQ ID NO: 31233 - protein, 238 aa, Staphylococcus aureus
  strain MRSA252
MNKNIIIKSIAALTILTSVTGVGTTMVEGIQQTAKAEHNVKLIKNTNVAPYNGIVSIGSGTGFIVGKNTIVTNKHVVAGMEIGAHIIAHPNGEYNNGGFYKVKKIVRYAGKEDIAILHVEDKAVHPKNRNFKDYTGILKIASEAKENERISIVGYPEPYINKFQMYESTGKVLSVKGNMIISDAFVEPGNSGSAVFNSKYEVVGVHFGGNGPANKSTKGYGVYFSPEIKKFIADNLDK

SEQ ID NO: 31234 - protein, 806 aa, Staphylococcus aureus
  strain MRSA252
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 31235 - protein, 331 aa, Staphylococcus aureus
  strain MRSA252
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDNSSVEKSESNEETAPVEPMPHSKPTTSEAPPSQNIHNEDSMYDASTE

SEQ ID NO: 31236 - protein, 2189 aa, Staphylococcus aureus
  strain MRSA252
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKDTQLIIDEILAIKLPAEVIKASPKVGQPAPKVCTPIKKEDKQEVRKVVKELPNTGSEEMDLPLKELALITGAALLARRRSKKEKES

SEQ ID NO: 31237 - protein, 383 aa, Staphylococcus aureus
  strain MRSA252
MFIYYCKECFVMNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVPSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31238 - protein, 241 aa, Staphylococcus aureus
  strain MRSA252
MKKNITNKIVLSTALLLLGTTSTQPPKAPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNSYVKNPRHAEIEVILEKSH

SEQ ID NO: 31239 - protein, 241 aa, Staphylococcus aureus
  strain MRSA252
MKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPVAKPSDKHYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 31240 - protein, 238 aa, Staphylococcus aureus
  strain MRSA252
MRKCIMKKLILMTTLLLLGTTATQTSNSPLNVSTDAKAYHIGQDETNINELIKYYTQLPLTFSNRWLYQYDDGNIYVEFKRYSWSAHIRLWGAESWGNVNQLRDRYVDVFGLKDEDTSQLWWVYRDTFTGGVTPAASPSDKPYSLFVQYKDKLQTIIGAHKMYQGNKPILTLKEIDFRARETLIKNKILYHENRNKGKLKITGGGNDFTIDLSKRLHSDLANVYVKNPQKITVEVLID

SEQ ID NO: 31241 - protein, 165 aa, Staphylococcus aureus
  strain MRSA252
MKNKLIAKSLLAIAAIGITTTTIASTADASEGYGPREKKPVSINHNIVEYNDGTFKYQSRPKFNTTPKYIKFRHDYNIVEYNDGTFEYGARPQFNKPAAKTEATIKKEQKLIQAQNLVREFEKTHTVSAHRKAQKAVNLVSFEYNVKKMILQERIDQVLKQGLVR

SEQ ID NO: 31242 - protein, 105 aa, Staphylococcus aureus; identical to SEQ ID NO: 31168
  strain MRSA252

SEQ ID NO: 31243 - protein, 227 aa, Staphylococcus aureus
  strain MRSA252
MKNILKVFNTMILALIIIIATFSNTANAADSGTLNYEVYKYNTNDTSIANDYFNKPAKYIKKNGKLYVQITVNHSHWITGMSIEGHKERIISKNTAKDERTSEFEVSKLNGKIDGKIDVYIDEKVNGKPFKYDHHYNITYKFNGPSDVAGANAPGKDDKNSASGSDKGSDGATTGQSESNSSNKDKVENPQTNAGTPAYIYAIPVASLALLIAITLFVRKKSKGNVE

SEQ ID NO: 31244 - protein, 354 aa, Staphylococcus aureus; identical to SEQ ID NO: 30412
  strain MRSA252

SEQ ID NO: 31245 - protein, 652 aa, Staphylococcus aureus
  strain MRSA252
MNKQQKEFKSFYSIRKSSLGVASVAISTLLLLMSNGEAKAAEETGVTNTEAQPKTEAVASPTTTTTEKAPEAKPVAKPVANAVSVSNKEVVAPTTETKEAKEVKAVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDAFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAMPSKPTTPPVEKESQKQDSQKDDNKQSPSVEKENDASSESGKDKMPVTKPAKAEVESSSTTPTKVVSTTQNVAKPTTASSETTKDVVQTSAGSSEAKDSAPLQKANIKNTNDGHTQSQNNKNTQENKAKSLPQTGEESNKDMTLPLMALIALSSIVAFVLPRKRKN

SEQ ID NO: 31246 - protein, 1257 aa, Staphylococcus aureus
  strain MRSA252
MAKKFNYKLPSMVALTLVGSAVTAHQVQAAETTQDQTTNKNVLDSNKVKATTEQAKAEVKNPTQNISGTQVYQDPAIVQPKAANKTGNAQVNQKVDTTQVNGDTRATQSTTSNNAKPVTKSTNTTAPKTNNNVTSAGYSLVDDEDDNSENQINPELIKSAAKPAALETQYKAAAPKATPVAPKAKTEATPKVTTFSASAQPRSAAAAPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPSTPSKPSTPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLYGTVNGKSGWISKAYLAVPAAPKKAVAQPKTAVKAYAVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNRSNNGLSMVPWGTKNQVILTGNNIAQGTFNATKQVSVGKDVYLYGTINNRTGWVNSKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQIGMTLNQVAQIQAGLQYKPQVQRVPGKWTDANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 31247 - protein, 357 aa, Staphylococcus aureus
  strain MRSA252
MKGKFLKVSSLFVATLTTATLVSSPAANALSSKAMDNHPQQTQTDKQQTPKIQKGGNLKPLEQRERANVILPNNDRHQITDTTNGHYAPVTYIQVEAPTGTFIASGVVVGKDTLLTNKHIVDATHGDPHALKAFASAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNQFNGAVFINENVRNFLKQNIEDINFANDDHPNNPDNPDNPNNPDNPNNPDNPNNPDNPDNPNNPDNPNNPDNPNNPDQPNNPNNPDNGDNNNSDNPDAA

SEQ ID NO: 31248 - protein, 393 aa, Staphylococcus aureus
  strain MRSA252
MNSSCKTRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLANNIKEKESAKTVSPQLKQELKTTVTPTKVEENEAIQEDQVQYENTLKNFKIREQQFDNSWCAGFSMAALLNATKNTDTYNAHDIMRTLYPEVSEQDLPNCATFPNQMIEYGKSQGRDIHYQEGVPSYNQVDQLTKDNVGIMILAQSVSQNPNDPHLGHALAVVANAKINDQEKLIYWNPWDTELSIQDADSSLLHLSFNRDYNWYGSMIGY

SEQ ID NO: 31249 - protein, 228 aa, Staphylococcus aureus
  strain MRSA252
MTEYLLSAGICMAIVSILLIGMAISNVSKEQYAKRFFFFATSCLVLTLVVASSLSSSANASQTDNGVNRSGSEYPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQLLRKSEAQAKKEKLNIWSEDNADSGQ

SEQ ID NO: 31250 - protein, 1029 aa, Staphylococcus aureus
  strain MRSA252
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 31251 - protein, 434 aa, Staphylococcus aureus [sequence omitted]

SEQ ID NO: 31252 - protein, 646 aa, Staphylococcus aureus; identical to SEQ ID NO: 30757
  strain MRSA252

SEQ ID NO: 31253 - protein, 254 aa, Staphylococcus aureus
  strain MRSA252
MTVEERSNTAKVDILGVDFDNTTMLQMVENIKTFFANQSTNNLFIVTANPEIVNYATTHQAYLELINQASYIVADGTGVVKASHRLKQPLAHRIPGIELMDECLKIAHVNHQKVFLLGATNEVGEAAQYALQQRYPNISFAHHHGYIDLEDETVVKRIELFKPDYIFVGMGFPKQEEWIMTHENQFESKVMMGVGGSLEVFAGAKKRAPYIFRKLNIEWIYRALIDWKRIGRLKSIPIFMYKIAKAKRKIKKAK

SEQ ID NO: 31254 - protein, 1137 aa, Staphylococcus aureus
  strain MRSA252
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31255 - protein, 906 aa, Staphylococcus aureus
  strain MRSA252
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31256 - protein, 334 aa, Staphylococcus aureus
  strain MRSA252
MQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNSTSNSSRPSTNSSGGSYYTVQAGDSLSLIASKYGTTYQNIMRLNGLNNFFIYPGQKLKVTGNASTNSGSTTTTNRGYNTPVFNHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 31257 - protein, 232 aa, Staphylococcus aureus
  strain MRSA252
MKLKNIAKASLALGILTTGMITTTAQPVKASEQSRLSVTSNDTQELKKYYSGTGYNFQNVSGYREKDKMNIIDGTQLNVVTLLGTDKERFKDYDYDYEGLDVFVVREGSGKQAENISIGGITKTNKNDYKDFVNNVGLEITKPTGHNTATRQAETYRINKEEISLKELDFKLRKHLIENHELYKTEPKDGKIRITMKGGGYYTFELNKKLQPHRMGDVIDGRNIEKIEVDLY

SEQ ID NO: 31258 - protein, 227 aa, Staphylococcus aureus; identical to SEQ ID NO: 30564
  strain MRSA252

SEQ ID NO: 31259 - protein, 232 aa, Staphylococcus aureus; identical to SEQ ID NO: 30565
  strain MRSA252

SEQ ID NO: 31260 - protein, 231 aa, Staphylococcus aureus; identical to SEQ ID NO: 30566
  strain MRSA252

SEQ ID NO: 31261 - protein, 234 aa, Staphylococcus aureus; identical to SEQ ID NO: 30567
  strain MRSA252

SEQ ID NO: 31262 - protein, 306 aa, Staphylococcus aureus
  strain MRSA252
MKMTQIAKTSLALSLLTTGASIVTTQSANAEVASALKTEQAIKSKIQKVTTSPSPNVQPQSPQPTPSVTTPPSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 31263 - protein, 343 aa, Staphylococcus aureus
  strain MRSA252
MKIRTIAKASIALGLVTTGASIVTTQSANAEVASALKAGQLAKINVSTSAITTTAQAVNAEQNHTANPEQAAKSNTENVSTSLSTQTEQTPKSNIQKATQPAPSGTTQSLPNAQPQSTQPTPSVTTPPSSNVETPQPTSPTTKQAQKEINPKFKGLRSYYTKSSLEFKNELGIIIKKWTTIRFMNIVPDYFIYKIALVGKDDKKYGEGVHRHVDVFIVLEQNKYGVDKYSVGGITKANRKKVDYKTGISITKEDKKGTISHDVSEYKITKEEISLKELDFKLRKQLIEQHNLYGNIGSGTIVIKMKNGGKYTFELHKKLQQHRMADVIDGTNIDRIEVNLKSS

SEQ ID NO: 31264 - protein, 233 aa, Staphylococcus aureus
  strain MRSA252
MKMKSIAKVSLVLGILATGVNTVTEQPVHAENKHVQVSQNSKNLKAYYTQPSVEYKNVTGYISSIQPKPGTKFLNMIEGNTVNNLALVGKDKEHYHTGVHRNLDIFYVNEDKRFEGAKYSIGGITKASDKVVDQVAEARVIKEDHTGEYDYDFFPFKIDKEAMTLKEVDFKIRKHLIDHYGLYGEMSSGTVTVQMKYYGKYTIELDKKLQEDRMADIVKVIDIDRIEVKVKKA

SEQ ID NO: 31265 - protein, 226 aa, Staphylococcus aureus
  strain MRSA252
MKFKAIAKASLALGMLATGVITSNIQSVQAKTEVKQQSEADLKLYYNGPSFEYKKVTGYGFIEGKDRFIDFIYNGQYNKISLVGSDKDKYNEEVNPDIDVFVVREGNGRQADNHSIGGVTKTNRGVYYDYIHSPILEIKKGNEEPQNSLYQIYKENISLKELDYRLRERAIKQHGLYSNGLKQGQITITMKDGKSHTIDLSQKLEKERMGDSIDGRQIQKILVEMK

SEQ ID NO: 31266 - protein, 691 aa, Staphylococcus aureus; identical to SEQ ID NO: 31040
  strain MRSA252

SEQ ID NO: 31267 - protein, 97 aa, Staphylococcus aureus; identical to SEQ ID NO: 30774
  strain MRSA252

SEQ ID NO: 31268 - protein, 316 aa, Staphylococcus aureus
  strain MRSA252
MKKLTAAAIATMGFATFTMAHQADAAETTNTQQAHTQMSTQSQDVSYGTYYTIDSNGDYHHTPDGNWNQAMFDNKEYSYTFVDAQGHKHYFYNCYPKNANANGSGQTYVNQATAGDNNDYTASQSQQHINQYGYQSNVGPDASYYSHSNNNQAYNSHNGNGKVNYPNGTSNQNGGSASKATASGHAKDASWLTSRKQLQPYGQYHGGGAHYGVDYAMPENSPVYSLTDGTVVQAGWSNYGGGNQVTIKEANSNNYQWYMHNNRLTVSAGDKVKAGDQIAYSGSTGNSTAPHVHFQRMSGGIGNQYAVDPTSYLQSR

SEQ ID NO: 31269 - protein, 221 aa, Staphylococcus aureus; identical to SEQ ID NO: 31036
  strain MRSA252

SEQ ID NO: 31270 - protein, 516 aa, Staphylococcus aureus
  strain MRSA252
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31271 - protein, 1183 aa, Staphylococcus aureus
  strain MSSA476
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVKAVDVTSETNWKYEFKDLPKYDEGKKIEYTVTEDHVKDYTTDINGTTITNKYTPGETSATVTKNWDDNNNQDGKRPTEIKVELYQDGKATGKTAKLNESNNWTHTWTGLDEKAKGQQVKYTVEELTKVKGYTTHVDNNDMGNLIVTNKYTPETTSINGEKVWDDKDNQDGKRPEKVSINLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31272 - protein, 680 aa, Staphylococcus aureus; identical to SEQ ID NO: 30700
  strain MSSA476

SEQ ID NO: 31273 - protein, 290 aa, Staphylococcus aureus
  strain MSSA476
MKYRKFIILVLSILIILPVSTLDGHHIANADDDSPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDLHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKD

SEQ ID NO: 31274 - protein, 2275 aa, Staphylococcus aureus
  strain MSSA476
MSKRQKEFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSKSLSTSTSESSSTSASLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSASISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 31275 - protein, 175 aa, Staphylococcus aureus; identical to SEQ ID NO: 30554
  strain MSSA476

SEQ ID NO: 31276 - protein, 905 aa, Staphylococcus aureus
  strain MSSA476
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSESDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 31277 - protein, 233 aa, Staphylococcus aureus; identical to SEQ ID NO: 30428
  strain MSSA476

SEQ ID NO: 31278 - protein, 255 aa, Staphylococcus aureus; identical to SEQ ID NO: 30706
  strain MSSA476

SEQ ID NO: 31279 - protein, 1015 aa, Staphylococcus aureus
  strain MSSA476
MKNNLRYGIRKHKLGAASVFLGTMIVVGMGQDKEAAASEQKTTTVEENGNSATENKVNETQTTTTNVNTIDETQSYSATATEQPSNATQVTTEEAPKAVQAPQTAQPANLETVKEEVVKEEAKPQVKETTQSQDNSGDQRQVDLTPKKATQNQVAETQVEVAQPRTASESKPRVTRSADVVEAKEASDEKVETGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHTEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 31280 - protein, 957 aa, Staphylococcus aureus
  strain MSSA476
MKSNLRYGIRKHKLGAASVFLGTMIVVGMGQEKEAAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAERVTLKYKWKFEDGIKPGDYFDFTLSNNVETHGISPLRKVPDIKSKDDNILAVGKVMDERKIRYTFTDYINNKNNLMAELNLNLFIDPTTVTKQGKQTVEVKLGENKISKEFDIKYLDGVKDNWGVTVNGRITLLDKENSKIHHLAYINPKKSDMTSITINGFFAKGGLYTGNVPTVKVYEYLRSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNDPIIEKSEPIELDIKSEPPVEKHELTGTIEESNDSKPIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVDFEEDTLPQVSGHNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 31281 - protein, 1371 aa, Staphylococcus aureus
  strain MSSA476
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPIDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPIDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKITQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 31282 - protein, 325 aa, Staphylococcus aureus; identical to SEQ ID NO: 30407
  strain MSSA476

SEQ ID NO: 31283 - protein, 315 aa, Staphylococcus aureus
  strain MSSA476
MLKNKILATTLSVSLLAPLANPLLENAKAANDTEEIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 31284 - protein, 309 aa, Staphylococcus aureus; identical to SEQ ID NO: 30406
  strain MSSA476

SEQ ID NO: 31285 - protein, 437 aa, Staphylococcus aureus
  strain MSSA476
MKNKYISKLLVGAATITLATMISNGEAKASENTQQTSTKHQTTQNNYVTDQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNVKDSIENRRLAQREVNKAPMDVKEHLQKQLDALVAQKDAEKKVAPKVEAPQIQSPQIEKPKAESPKVEVPQIQSPKVEVPQSKLLGYYQSLKDSFNYGYKYLTDTYKSYKEKYDTAKYYYNTYYKYKGAIDKAVLTLLGDGSKSYIQPLKVDDKNGYLAKSYAQVRNYVTESINTGKVLYTFYQNPTLVKTAIKAQETASSIKNTITGLFNSFWK

SEQ ID NO: 31286 - protein, 269 aa, Staphylococcus aureus
  strain MSSA476
MKKIATATIATAGFATIAIASGNQAHASEQDNYGYNPNDPTSYSYTYTIDAQGNYHYTWKGNWHPSQLNQDNGYYSYYYYNGYNNYNYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNSNGSVRVSEMNYGYGPGVVTSRTISASQAAGYNFIH

SEQ ID NO: 31287 - protein, 141 aa, Staphylococcus aureus; identical to SEQ ID NO: 30633
  strain MSSA476

SEQ ID NO: 31288 - protein, 815 aa, Staphylococcus aureus
  strain MSSA476
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 31289 - protein, 231 aa, Staphylococcus aureus; identical to SEQ ID NO: 31073
  strain MSSA476

SEQ ID NO: 31290 - protein, 26 aa, Staphylococcus aureus
  strain MSSA476
MAQDIISTISDLVKWIIDTVNKFTKK

SEQ ID NO: 31291 - protein, 350 aa, Staphylococcus aureus
  strain MSSA476
MKNKKRVLIASSLSCAILLLSAATTQANSAHKDSQDQNKKEHVDKSQQKEKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYSDNKSFREG

SEQ ID NO: 31292 - protein, 338 aa, Staphylococcus aureus
  strain MSSA476
MIKQLYKNITICTLALSTTFTVLPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHNVKFVKVLNDNEKK

SEQ ID NO: 31293 - protein, 242 aa, Staphylococcus aureus
  strain MSSA476
MKKLISILLINIIILGVSNNASAQGDIGIDNLRNFYTKKDFINLKDVKDNDTPIANQLQFSNESYDLISESKDFNKFSNFKGKKLDVFGISYNGQCNTKYIYGGITATNEYLDKPRNIPINIWINGNHKTISTNKVSTNKKFVTAQEIDIKLRRYLQEEYNIYGHNGTKKGEEYGHKSKFYSGFNIGKVTFHLNNNDTFSYDLFYTGDDGLPKSFLKIYEDNKTVESEKFHLDVDISYKETK

SEQ ID NO: 31294 - protein, 242 aa, Staphylococcus aureus
  strain MSSA476
MNKIFRVLTVSLFFFTFLIKNNLAYADVGVINLRNFYANYQPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYKSKFNSGFNKGKITFHLNNEPSFTYDLFYTGTGQAESFLKIYNDNKTIDAENFHLDVEISYEKTE

SEQ ID NO: 31295 - protein, 257 aa, Staphylococcus aureus; identical to SEQ ID NO: 30259
  strain MSSA476

SEQ ID NO: 31296 - protein, 163 aa, Staphylococcus aureus; identical to SEQ ID NO: 30429
  strain MSSA476

SEQ ID NO: 31297 - protein, 116 aa, Staphylococcus aureus; identical to SEQ ID NO: 31223
  strain MSSA476

SEQ ID NO: 31298 - protein, 388 aa, Staphylococcus aureus
  strain MSSA476
MKRNFPKLIALSLILSLSVTPIANAESNSNIKAKDKKHVQVNVEDKSIPTEVRNLAQKDYLSYVTSLDKIYNKEKASYTLGEPFKIYKFNKKSDGNYYFPVLNTEGNIDYIVTISPKVTKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYVNKLENFKIRETQGNNGWCAGYTMSALLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNPWDNGFMTQDAKNNVIPVSNGDHYQWYSSIYGY

SEQ ID NO: 31299 - protein, 311 aa, Staphylococcus aureus; identical to SEQ ID NO: 30617
  strain MSSA476

SEQ ID NO: 31300 - protein, 327 aa, Staphylococcus aureus; identical to SEQ ID NO: 30538
  strain MSSA476

SEQ ID NO: 31301 - protein, 235 aa, Staphylococcus aureus
  strain MSSA476
MNENVMVKGLTALTILTSLGFAENISNQPHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHELIGILYAGSGKDESEKNFGVYFTPQLKEFIQNNIEK

SEQ ID NO: 31302 - protein, 240 aa, Staphylococcus aureus
  strain MSSA476
MNKNVVIKSLAALTILTSVTGIGITLVEEVQQTAKAENNVTKVKDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 31303 - protein, 239 aa, Staphylococcus aureus
  strain MSSA476
MNKNIVIKSMAALAILTSATGINAAVVEETQQIANAEKNVTQVKDTNIFPYNGVVSFKDATGFVIGKNTIITNKHVSKDYKVGDRITAHPDGDKGNGGIYKIKSISDYPGDEDISVMNIEEQAVERGPKGFNFNENVQALNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 31304 - protein, 239 aa, Staphylococcus aureus
  strain MSSA476
MNKNIIIKSIAALTILTSITGVGTTVVDGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 31305 - protein, 331 aa, Staphylococcus aureus
  strain MSSA476
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSIAPTNAKGTFVVADVTIKNKGKEALTIDSSMFKLKSGDKTFEADNTGSMSANQNDNGSIENSFFLQRINPDSTAQGKIVFDVSENIANAKDKKLEVISSLFSVKKITFDLSDAKKTSKAKKDKQDTEVAAASSNSDNVSYEASATTPATTSSANNDSEENEQSSKDEDKQNASKSDKSSVEKSESNEETATVESAPQSKPVTSEAPPNQNNHNEDSMYDASTE

SEQ ID NO: 31306 - protein, 2186 aa, Staphylococcus aureus
  strain MSSA476
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPWAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGSVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNKKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVISRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEAMKVSPKVIQPAPKVCTPIKKEETHESRKVEKELPNTGSEEMDLPLKEFALITGAALLARRRTKNEKES

SEQ ID NO: 31307 - protein, 895 aa, Staphylococcus aureus
  strain MSSA476
MNKHHPKLRSFYSIRKSILGVASVIVSTLFLITSQHQAQAAENTNTSDKISENQNNNATTTQPPKDTNQTQPATQPANTAKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTINNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPDSDVVKDADNNIDKDVQHDVDHLSDMSDNNHFDKYDLKEMDTQIAKDTDRNVDKGADNSVGMSSNVDTDKDSNKNKDKVIQLNHIADKNNHNGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 31308 - protein, 291 aa, Staphylococcus aureus; identical to SEQ ID NO: 30390
  strain MSSA476

SEQ ID NO: 31309 - protein, 229 aa, Staphylococcus aureus
  strain MSSA476
MTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKYHNDDEQNIEYNFYNLNGEYGYEVLKMYADNKTINSDKLHLDIYLFKS

SEQ ID NO: 31310 - protein, 383 aa, Staphylococcus aureus
  strain MSSA476
MFVYYCKECFIMNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31311 - protein, 241 aa, Staphylococcus aureus
  strain MSSA476
MKKNIMNKLVLSTALLLLGTTSTQLPKTPISFSSEAKAYNISENETNINELIKYYTQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 31312 - protein, 241 aa, Staphylococcus aureus; identical to SEQ ID NO: 30739
  strain MSSA476

SEQ ID NO: 31313 - protein, 238 aa, Staphylococcus aureus
  strain MSSA476
MSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKGRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 31314 - protein, 319 aa, Staphylococcus aureus; identical to SEQ ID NO: 30495
  strain MSSA476

SEQ ID NO: 31315 - protein, 165 aa, Staphylococcus aureus
  strain MSSA476
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVK

SEQ ID NO: 31316 - protein, 132 aa, Staphylococcus aureus
  strain MSSA476
MKKNITKVIIASTVIATGLLTQTNDAKAFFSYEWKGLEIAKNLADQAKKDDERADKLIKEADEKNEHYKGKTVEDLYVIAKKMGKGNTIAVVKIKDGGKNGYYTFDITRPLEEHRKNIPVVKNGEIDSITWY

SEQ ID NO: 31317 - protein, 105 aa, Staphylococcus aureus
  strain MSSA476
MKKNFIGKSILSIAAISLTVSTFAGESHAQTKVEKYNEYQTNFKKQVNKKVVDAQKAVNLFKRTRTVATHRKAQRAVNLIHFQHSYEKKKLQRQIDLVLKYNTLK

SEQ ID NO: 31318 - protein, 227 aa, Staphylococcus aureus; identical to SEQ ID NO: 30927
  strain MSSA476

SEQ ID NO: 31319 - protein, 350 aa, Staphylococcus aureus; identical to SEQ ID NO: 30602
  strain MSSA476

SEQ ID NO: 31320 - protein, 645 aa, Staphylococcus aureus
  strain MSSA476
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQKVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 31321 - protein, 1250 aa, Staphylococcus aureus
  strain MSSA476
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKAAAPKAATTSAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINEQTWYYGKLSNGKLAWIKSTDLAKELIKYNQTGMTLNQVAQIQAGLQYKPQVQRVPGKWTDANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDIDWANINAKIIKGYYDKIGEVGKYFDIPQYK

SEQ ID NO: 31322 - protein, 333 aa, Staphylococcus aureus
  strain MSSA476
MKGKFLKVSSLFVATLTTATLVSSPAANALSSKAMDNHPQQSQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDNPNNPNNPDNPDNGDNNNSDNPDAA

SEQ ID NO: 31323 - protein, 393 aa, Staphylococcus aureus
  strain MSSA476
MNSSYKSRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLPGNVKEKESAKTVSSKLKQELKNTVTPTKVEENEAIQEDQVQYENTLKNFKIREQQFDNSWCAGFSMAALLNATKNTDTYNAHDIMRTLYPEVSEQDLPNCSTFPNQMIEYGKSQGRDIHYQEGVPSYEQVDQLTKDNVGIMILAQSVSQNPNDPHLGHALAVVGNAKINDQEKLIYWNPWDTELSIQDADSSLLHLSFNRDYNWYGSMIGY

SEQ ID NO: 31324 - protein, 228 aa, Staphylococcus aureus
  strain MSSA476
MTEYLLSAGICMAIVSILLIGMAISNVSKGQYAKRFFFFATSCLVLTLVVVSSLSSSANASQTDNGVNRSGSEHPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQLLRKSEAQAKKEKLNIWSEDNADSGQ

SEQ ID NO: 31325 - protein, 928 aa, Staphylococcus aureus
  strain MSSA476
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 31326 - protein, 434 aa, Staphylococcus aureus [sequence omitted]

SEQ ID NO: 31327 - protein, 646 aa, Staphylococcus aureus; identical to SEQ ID NO: 30757
  strain MSSA476

SEQ ID NO: 31328 - protein, 254 aa, Staphylococcus aureus; identical to SEQ ID NO: 30556
  strain MSSA476

SEQ ID NO: 31329 - protein, 1141 aa, Staphylococcus aureus
  strain MSSA476
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31330 - protein, 1365 aa, Staphylococcus aureus
  strain MSSA476
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSNNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 31331 - protein, 957 aa, Staphylococcus aureus
  strain MSSA476
MNNKKTVTNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVSLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 31332 - protein, 334 aa, Staphylococcus aureus; identical to SEQ ID NO: 30414
  strain MSSA476

SEQ ID NO: 31333 - protein, 230 aa, Staphylococcus aureus
  strain MSSA476
MKLKNIAKASLALGILTTGMITTTAQPVKAIEQSRLSVTSKDTQELKKYYSGTGYNFQNVSGYREGNKMNIIDGPQLNVVTLLGTDKERFKDDEDYEGLDVFVVREGSGKHADNISIGGITKTNKNQYKDPVQNVNLLTSKSNGQNTASVTSEYYSINKEEISLKELDFKLRKQLIDKHDLYKTEPKDSKIKVSMKNGGYYTFELNKKLQPHRMGDTIDSRNIKKIEVNL

SEQ ID NO: 31334 - protein, 227 aa, Staphylococcus aureus
  strain MSSA476
MKLTAIAKAALALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 31335 - protein, 232 aa, Staphylococcus aureus
  strain MSSA476
MKFTALAKATLALGILTTGVFTTESKAVHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKIDPKHGFSINELFFIQKEEVSLKELDFKIRKMLVEKYRLYKGASDKGRIVINMKDEKKYVIDLSEKLSFDRMFDVMDSKQIKNIEVNLN

SEQ ID NO: 31336 - protein, 234 aa, Staphylococcus aureus
  strain MSSA476
MNMKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSYDEFFFIQKEEVSLKELDFKIRKLLIKKYKLYEGAADKGRIVINMKDENKYEIDLSDKLGFERMADVINSEQIKNIEVNLK

SEQ ID NO: 31337 - protein, 231 aa, Staphylococcus aureus
  strain MSSA476
MKLKTLAKATLALGLLTTGVITSEGQAVQAKEKQERVQHLYDIKDLHRYYSSESFEFSNISGKVENYNGSNVVRFNQENQNHQLFLSGKDKDKYKEGLEGQNVFVVKELIDPNGRLSTVGGVTKKNNQSSETNTPLFIKKVYGGNLDASIESFLINKEEVSLKELDFKIRQHLVKNYGLYKGTTKYGKITFNLKDGEKQEIDLGDKLQFEHMGDVLNSKDIQNIAVTINQI

SEQ ID NO: 31338 - protein, 232 aa, Staphylococcus aureus
  strain MSSA476
MKLKALAKATLVLGLLATGVITTESQTVKAAESTQGQHNYKSLKYYYSKPSIELINVDGLYRQHLTDKGAYVWKNLKDYYIGLLGEDSKKFKSDVYGDLDAFLVIEEEPVKGRQYSIGGISKTNSKEFKEREVDVKVTRKADRDTTSTKDSKFKITKEEISLKELDFKLRQKLMKEENLYDAINHRKGKIVVKMEDDKFYTFELTKKLQPHRMGDTIDGTKIKEINVELEYK

SEQ ID NO: 31339 - protein, 234 aa, Staphylococcus aureus
  strain MSSA476
MKMAAIAKASLALGILATGTITSLHQTVNASEHEAKYENVTKDIFDLRDYYSGASKELKNVTGYRYSKGGKHYLIFDKHQKFTRIQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 31340 - protein, 315 aa, Staphylococcus aureus
  strain MSSA476
MKITTIAKTSLALGLLTTGVITTTTQAANATTPPSTKVETPQQVANATTPSSTKVEAPQQAANATTPSSTKVEAPQSKPNATTPSSTKVEAPQQAANATTPPSSNVDTSPPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 31341 - protein, 356 aa, Staphylococcus aureus
  strain MSSA476
MKMRTITKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTQQTKMTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 31342 - protein, 231 aa, Staphylococcus aureus
  strain MSSA476
MKMKSIVKISLLLGILATGVNTTTEKPVHAEKKPIVISENSKKLKAYYTQPSIEYKNVTGYISFIQPSIKFMNIIDGNSVNNIALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 31343 - protein, 226 aa, Staphylococcus aureus
  strain MSSA476
MKFKAIAKASLALGMLATGVITSNVQSVQAKTEVKQQSEADLKLYYNGPSFEYKKVTGYGFIEGKDRFIDFIYNGQYNKISLVGSDKDKYNEEVNPDIDVFVVREGNGRQADNHSIGGITKTNRGVYYDYIHTPILEIKKGKEEPQSSLYQIYKEDISLKELDFKLRKQLISQSGLYSNGLKQGQITITMNDGTTHTIDLSQKLEKERMGESIDGRQIQKILVEMK

SEQ ID NO: 31344 - protein, 203 aa, Staphylococcus aureus
  strain MSSA476
MFKKNDSKNSILLKSILSLGIIYGGTFGIYPKADASTQNSPSVQDKQFQKVEEVPNNSEKALVKKLYDRYSQNTINGKSNKSRNWVYSERPLNENQVRINLEGTYRVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 31345 - protein, 690 aa, Staphylococcus aureus
  strain MSSA476
MLRGQEERKYSIRKYSIGVVSVLAATMFVVSSHEAQASEKTPTNAAVQKETLNQPGEQGNAITSHQMQSGKQLDDMHKENGKSGTVTEGKDTLQLSKYQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 31346 - protein, 104 aa, Staphylococcus aureus
  strain MSSA476
MGGYKGIKADGGKVDQAKQLAAKTAKDIEACQKQTQQLAEYIEGSDWEGQFANKVKDVLLIMAKFQEELVQPIADHQKAIDNLSQNLAKYDTLSIKQGLDRVNP

SEQ ID NO: 31347 - protein, 130 aa, Staphylococcus aureus
  strain MSSA476
MNFNDIETMVKSKFKDIKKHAEEIAHEIEVRSGYLRKAEQYKRLEFNLSFALDDIESTAKDVQTAKTSANKDSVTVKGKAPNTLYIEKRNLMKQKLEMLGEDIDKNKESLQKAKEIAGEKASEYFNKAMN

SEQ ID NO: 31348 - protein, 97 aa, Staphylococcus aureus; identical to SEQ ID NO: 30774
  strain MSSA476

SEQ ID NO: 31349 - protein, 316 aa, Staphylococcus aureus
  strain MSSA476
MKKLTAAAIATMGFATFTMAHQADAAETTNTQQAHTQMSTQSQDVSYGTYYTIDSNGDYHHTPDGNWNQAMFDNKEYSYTFVDAQGHTHYFYNCYPKNANANGSGQTYVNPAIAGDNNDYTASQSQQHINQYGYQSNVGPDASYYSHSNNNQAYNSHDGNGKVNYPNGTSNQNGGLASKATASGHAKDASWLTSRKQLQPYGQYHGGGAHYGVDYAMPENSPVYSLTDGTVVQAGWSNYGGGNQVTIKEANSNNYQWYMHNNRLTVSAGDKVKAGDQIAYSGSTGNSTAPHVHFQRMSGGIGNQYAVDPTSYLQSR

SEQ ID NO: 31350 - protein, 241 aa, Staphylococcus aureus
  strain MSSA476
MKKLATVGSLIVTSTLVFSSMPFQNAHADTTSMNVSNKQSQNVQNHRPYGGVVPQGMTQAQYTELEKALSQLSAGSNMQDYNMKLYDATQNIADKYNVIITTNVGVFKPHAVRDMNGHALPLTKDGNFYQTNVDANGINHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 31351 - protein, 492 aa, Staphylococcus aureus
  strain MSSA476
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNNKPGKEDGNKPGKEDNKKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31352 - protein, 241 aa, Staphylococcus aureus; identical to SEQ ID NO: 30411
  strain MSSA476

SEQ ID NO: 31353 - protein, 450 aa, Staphylococcus aureus
  strain Mu3 / ATCC 700698
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31354 - protein, 241 aa, Staphylococcus aureus; identical to SEQ ID NO: 30571
  strain Mu3 / ATCC 700698

SEQ ID NO: 31355 - protein, 691 aa, Staphylococcus aureus; identical to SEQ ID NO: 30511
  strain Mu3 / ATCC 700698

SEQ ID NO: 31356 - protein, 203 aa, Staphylococcus aureus; identical to SEQ ID NO: 30576
  strain Mu3 / ATCC 700698

SEQ ID NO: 31357 - protein, 226 aa, Staphylococcus aureus; identical to SEQ ID NO: 30577
  strain Mu3 / ATCC 700698

SEQ ID NO: 31358 - protein, 231 aa, Staphylococcus aureus
  strain Mu3 / ATCC 700698
MKMKNIAKISLLLGILATGVNTTTEKPVHAEKKPIVISENSKKLKAYYTQPSIEYKNVTGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIVKEAMSLKEIDFKLRKYLIDNYGLYGEMSTGKITVKKKYYGKYTFELDKKLQEDRMSDVINVTDIDRIEIKVRKA

SEQ ID NO: 31359 - protein, 356 aa, Staphylococcus aureus; identical to SEQ ID NO: 30793
  strain Mu3 / ATCC 700698

SEQ ID NO: 31360 - protein, 292 aa, Staphylococcus aureus; identical to SEQ ID NO: 30580
  strain Mu3 / ATCC 700698

SEQ ID NO: 31361 - protein, 234 aa, Staphylococcus aureus; identical to SEQ ID NO: 30581
  strain Mu3 / ATCC 700698

SEQ ID NO: 31362 - protein, 231 aa, Staphylococcus aureus; identical to SEQ ID NO: 30582
  strain Mu3 / ATCC 700698

SEQ ID NO: 31363 - protein, 232 aa, Staphylococcus aureus; identical to SEQ ID NO: 30583
  strain Mu3 / ATCC 700698

SEQ ID NO: 31364 - protein, 232 aa, Staphylococcus aureus; identical to SEQ ID NO: 30584
  strain Mu3 / ATCC 700698

SEQ ID NO: 31365 - protein, 227 aa, Staphylococcus aureus; identical to SEQ ID NO: 30585
  strain Mu3 / ATCC 700698

SEQ ID NO: 31366 - protein, 227 aa, Staphylococcus aureus; identical to SEQ ID NO: 30586
  strain Mu3 / ATCC 700698

SEQ ID NO: 31367 - protein, 953 aa, Staphylococcus aureus; identical to SEQ ID NO: 30594
  strain Mu3 / ATCC 700698

SEQ ID NO: 31368 - protein, 1385 aa, Staphylococcus aureus; identical to SEQ ID NO: 30595
  strain Mu3 / ATCC 700698

SEQ ID NO: 31369 - protein, 1141 aa, Staphylococcus aureus
  strain Mu3 / ATCC 700698
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFILDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31370 - protein, 434 aa, Staphylococcus aureus [sequence omitted]

SEQ ID NO: 31371 - protein, 935 aa, Staphylococcus aureus
  strain Mu3 / ATCC 700698
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 31372 - protein, 1255 aa, Staphylococcus aureus; identical to SEQ ID NO: 30417
  strain Mu3 / ATCC 700698

SEQ ID NO: 31373 - protein, 645 aa, Staphylococcus aureus; identical to SEQ ID NO: 30601
  strain Mu3 / ATCC 700698

SEQ ID NO: 31374 - protein, 350 aa, Staphylococcus aureus; identical to SEQ ID NO: 30602
  strain Mu3 / ATCC 700698

SEQ ID NO: 31375 - protein, 227 aa, Staphylococcus aureus; identical to SEQ ID NO: 30927
  strain Mu3 / ATCC 700698

SEQ ID NO: 31376 - protein, 109 aa, Staphylococcus aureus; identical to SEQ ID NO: 30603
  strain Mu3 / ATCC 700698

SEQ ID NO: 31377 - protein, 165 aa, Staphylococcus aureus; identical to SEQ ID NO: 30418
  strain Mu3 / ATCC 700698

SEQ ID NO: 31378 - protein, 319 aa, Staphylococcus aureus; identical to SEQ ID NO: 30605
  strain Mu3 / ATCC 700698

SEQ ID NO: 31379 - protein, 238 aa, Staphylococcus aureus; identical to SEQ ID NO: 30606
  strain Mu3 / ATCC 700698

SEQ ID NO: 31380 - protein, 241 aa, Staphylococcus aureus; identical to SEQ ID NO: 30607
  strain Mu3 / ATCC 700698

SEQ ID NO: 31381 - protein, 241 aa, Staphylococcus aureus; identical to SEQ ID NO: 30608
  strain Mu3 / ATCC 700698

SEQ ID NO: 31382 - protein, 372 aa, Staphylococcus aureus; identical to SEQ ID NO: 30609
  strain Mu3 / ATCC 700698

SEQ ID NO: 31383 - protein, 62 aa, Staphylococcus aureus; identical to SEQ ID NO: 30610
  strain Mu3 / ATCC 700698

SEQ ID NO: 31384 - protein, 157 aa, Staphylococcus aureus; identical to SEQ ID NO: 30611
  strain Mu3 / ATCC 700698

SEQ ID NO: 31385 - protein, 291 aa, Staphylococcus aureus; identical to SEQ ID NO: 30390
  strain Mu3 / ATCC 700698

SEQ ID NO: 31386 - protein, 891 aa, Staphylococcus aureus; identical to SEQ ID NO: 30788
  strain Mu3 / ATCC 700698

SEQ ID NO: 31387 - protein, 1983 aa, Staphylococcus aureus
  strain Mu3 / ATCC 700698
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAGKRLMMILHASLL

SEQ ID NO: 31388 - protein, 331 aa, Staphylococcus aureus; identical to SEQ ID NO: 30615
  strain Mu3 / ATCC 700698

SEQ ID NO: 31389 - protein, 239 aa, Staphylococcus aureus
  strain Mu3 / ATCC 700698
MNKNIIIKSIAALTILTSVTGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 31390 - protein, 239 aa, Staphylococcus aureus
  strain Mu3 / ATCC 700698
MNKNIIIKSIAALTILTSITGVGTTVVDGIQQTAKAENSVKLITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVTSDAVVQPGSSGSPILNSKREAIGVMYASDKPTGESTRSFAVYFSPEIKKFIADNLDK

SEQ ID NO: 31391 - protein, 239 aa, Staphylococcus aureus; identical to SEQ ID NO: 30476
  strain Mu3 / ATCC 700698

SEQ ID NO: 31392 - protein, 240 aa, Staphylococcus aureus; identical to SEQ ID NO: 30475
  strain Mu3 / ATCC 700698

SEQ ID NO: 31393 - protein, 235 aa, Staphylococcus aureus; identical to SEQ ID NO: 30942
  strain Mu3 / ATCC 700698

SEQ ID NO: 31394 - protein, 327 aa, Staphylococcus aureus; identical to SEQ ID NO: 30616
  strain Mu3 / ATCC 700698

SEQ ID NO: 31395 - protein, 311 aa, Staphylococcus aureus; identical to SEQ ID NO: 30617
  strain Mu3 / ATCC 700698

SEQ ID NO: 31396 - protein, 258 aa, Staphylococcus aureus; identical to SEQ ID NO: 30410
  strain Mu3 / ATCC 700698

SEQ ID NO: 31397 - protein, 258 aa, Staphylococcus aureus; identical to SEQ ID NO: 30542
  strain Mu3 / ATCC 700698

SEQ ID NO: 31398 - protein, 136 aa, Staphylococcus aureus; identical to SEQ ID NO: 30620
  strain Mu3 / ATCC 700698

SEQ ID NO: 31399 - protein, 242 aa, Staphylococcus aureus; identical to SEQ ID NO: 30399
  strain Mu3 / ATCC 700698

SEQ ID NO: 31400 - protein, 239 aa, Staphylococcus aureus; identical to SEQ ID NO: 30622
  strain Mu3 / ATCC 700698

SEQ ID NO: 31401 - protein, 260 aa, Staphylococcus aureus; identical to SEQ ID NO: 30623
  strain Mu3 / ATCC 700698

SEQ ID NO: 31402 - protein, 106 aa, Staphylococcus aureus; identical to SEQ ID NO: 30624
  strain Mu3 / ATCC 700698

SEQ ID NO: 31403 - protein, 116 aa, Staphylococcus aureus; identical to SEQ ID NO: 31223
  strain Mu3 / ATCC 700698

SEQ ID NO: 31404 - protein, 260 aa, Staphylococcus aureus; identical to SEQ ID NO: 31068
  strain Mu3 / ATCC 700698

SEQ ID NO: 31405 - protein, 289 aa, Staphylococcus aureus
  strain Mu3 / ATCC 700698
MRDSKPNKYCCYKVSMYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGNDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 31406 - protein, 338 aa, Staphylococcus aureus; identical to SEQ ID NO: 30627
  strain Mu3 / ATCC 700698

SEQ ID NO: 31407 - protein, 351 aa, Staphylococcus aureus; identical to SEQ ID NO: 30628
  strain Mu3 / ATCC 700698

SEQ ID NO: 31408 - protein, 240 aa, Staphylococcus aureus; identical to SEQ ID NO: 30548
  strain Mu3 / ATCC 700698

SEQ ID NO: 31409 - protein, 266 aa, Staphylococcus aureus; identical to SEQ ID NO: 30409
  strain Mu3 / ATCC 700698

SEQ ID NO: 31410 - protein, 234 aa, Staphylococcus aureus; identical to SEQ ID NO: 30395
  strain Mu3 / ATCC 700698

SEQ ID NO: 31411 - protein, 44 aa, Staphylococcus aureus; identical to SEQ ID NO: 30513
  strain Mu3 / ATCC 700698

SEQ ID NO: 31412 - protein, 231 aa, Staphylococcus aureus; identical to SEQ ID NO: 30630
  strain Mu3 / ATCC 700698

SEQ ID NO: 31413 - protein, 2481 aa, Staphylococcus aureus
  strain Mu3 / ATCC 700698
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 31414 - protein, 809 aa, Staphylococcus aureus; identical to SEQ ID NO: 30632
  strain Mu3 / ATCC 700698

SEQ ID NO: 31415 - protein, 141 aa, Staphylococcus aureus; identical to SEQ ID NO: 30633
  strain Mu3 / ATCC 700698

SEQ ID NO: 31416 - protein, 426 aa, Staphylococcus aureus
  strain Mu3 / ATCC 700698
MKNKYISKLLVGAATITLATMISNGEAKASENTQQTSTKHQTTQNNYVTDQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNEKDSIENRRLAQREVNKAPMDVKEHLQKQLDALVAQKDAEKKVAPKVEAPQIQSPQIEKPKAESPKVEVPQSKLLGYYQSLKDSFNYGYKYLTDTYKSYKEKYDTAKYYYNTYYKYKGAIDQTVLTVLGSGSKSYIQPLKVDDKNGYLAKSYAQVRNYVTESINTGKVLYTFYQNPTLVKTAIKAQETASSIKNTLSNLLSFWK

SEQ ID NO: 31417 - protein, 309 aa, Staphylococcus aureus; identical to SEQ ID NO: 30406
  strain Mu3 / ATCC 700698

SEQ ID NO: 31418 - protein, 315 aa, Staphylococcus aureus; identical to SEQ ID NO: 30573
  strain Mu3 / ATCC 700698

SEQ ID NO: 31419 - protein, 325 aa, Staphylococcus aureus; identical to SEQ ID NO: 30407
  strain Mu3 / ATCC 700698

SEQ ID NO: 31420 - protein, 1115 aa, Staphylococcus aureus
  strain Mu3 / ATCC 700698
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 31421 - protein, 196 aa, Staphylococcus aureus; identical to SEQ ID NO: 30587
  strain Mu3 / ATCC 700698

SEQ ID NO: 31422 - protein, 961 aa, Staphylococcus aureus; identical to SEQ ID NO: 30589
  strain Mu3 / ATCC 700698

SEQ ID NO: 31423 - protein, 1038 aa, Staphylococcus aureus
  strain Mu3 / ATCC 700698
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEVGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 31424 - protein, 233 aa, Staphylococcus aureus; identical to SEQ ID NO: 30591
  strain Mu3 / ATCC 700698

SEQ ID NO: 31425 - protein, 211 aa, Staphylococcus aureus
  strain Mu3 / ATCC 700698
MKKVISLFVAILSVLIFTDNANAENNKPEGVNENSNLIPVRQPDANYPGPVSDIARVKKLDNLIDGTKDPNVIKQLKDDNEVPNNAVKAKDSKIVSDCRHLLKHPDNLIDGTKDPNVINQLKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 31426 - protein, 877 aa, Staphylococcus aureus; identical to SEQ ID NO: 30593
  strain Mu3 / ATCC 700698

SEQ ID NO: 31427 - protein, 2271 aa, Staphylococcus aureus; identical to SEQ ID NO: 30597
  strain Mu3 / ATCC 700698

SEQ ID NO: 31428 - protein, 681 aa, Staphylococcus aureus; identical to SEQ ID NO: 30598
  strain Mu3 / ATCC 700698

SEQ ID NO: 31429 - protein, 450 aa, Staphylococcus aureus; identical to SEQ ID NO: 31353
  strain Mu50 / ATCC 700699

SEQ ID NO: 31430 - protein, 309 aa, Staphylococcus aureus; identical to SEQ ID NO: 30406
  strain Mu50 / ATCC 700699

SEQ ID NO: 31431 - protein, 266 aa, Staphylococcus aureus; identical to SEQ ID NO: 30409
  strain Mu50 / ATCC 700699

SEQ ID NO: 31432 - protein, 258 aa, Staphylococcus aureus; identical to SEQ ID NO: 30410
  strain Mu50 / ATCC 700699

SEQ ID NO: 31433 - protein, 26 aa, Staphylococcus aureus
  strain Mu50 / ATCC 700699
MAQDIISTIGDLVKWIIDTVNKFTKK

SEQ ID NO: 31434 - protein, 434 aa, Staphylococcus aureus [sequence omitted]

SEQ ID NO: 31435 - protein, 680 aa, Staphylococcus aureus; identical to SEQ ID NO: 30845
  strain Mu50 / ATCC 700699

SEQ ID NO: 31436 - protein, 233 aa, Staphylococcus aureus; identical to SEQ ID NO: 30591
  strain Mu50 / ATCC 700699

SEQ ID NO: 31437 - protein, 388 aa, Staphylococcus aureus
  strain Mu50 / ATCC 700699
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTISPKITKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYINKLENFKIRETQGNNGWCAGYTMSALLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNPWDNGFMTQDAKNNVIPVSNGDHYRWYSSIYGY

SEQ ID NO: 31438 - protein, 165 aa, Staphylococcus aureus; identical to SEQ ID NO: 30418
  strain Mu50 / ATCC 700699

SEQ ID NO: 31439 - protein, 163 aa, Staphylococcus aureus; identical to SEQ ID NO: 30429
  strain Mu50 / ATCC 700699

SEQ ID NO: 31440 - protein, 175 aa, Staphylococcus aureus; identical to SEQ ID NO: 30554
  strain Mu50 / ATCC 700699

SEQ ID NO: 31441 - protein, 255 aa, Staphylococcus aureus; identical to SEQ ID NO: 30706
  strain Mu50 / ATCC 700699

SEQ ID NO: 31442 - protein, 234 aa, Staphylococcus aureus; identical to SEQ ID NO: 30395
  strain Mu50 / ATCC 700699

SEQ ID NO: 31443 - protein, 240 aa, Staphylococcus aureus; identical to SEQ ID NO: 30548
  strain Mu50 / ATCC 700699

SEQ ID NO: 31444 - protein, 242 aa, Staphylococcus aureus; identical to SEQ ID NO: 30399
  strain Mu50 / ATCC 700699

SEQ ID NO: 31445 - protein, 258 aa, Staphylococcus aureus; identical to SEQ ID NO: 30542
  strain Mu50 / ATCC 700699

SEQ ID NO: 31446 - protein, 240 aa, Staphylococcus aureus; identical to SEQ ID NO: 30475
  strain Mu50 / ATCC 700699

SEQ ID NO: 31447 - protein, 239 aa, Staphylococcus aureus; identical to SEQ ID NO: 30476
  strain Mu50 / ATCC 700699

SEQ ID NO: 31448 - protein, 239 aa, Staphylococcus aureus; identical to SEQ ID NO: 31390
  strain Mu50 / ATCC 700699

SEQ ID NO: 31449 - protein, 291 aa, Staphylococcus aureus; identical to SEQ ID NO: 30390
  strain Mu50 / ATCC 700699

SEQ ID NO: 31450 - protein, 1114 aa, Staphylococcus aureus
  strain Mu50 / ATCC 700699
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPRSAKNNNRIRKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTTTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 31451 - protein, 325 aa, Staphylococcus aureus
  strain Mu50 / ATCC 700699
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQICWNGFYWAGANYKNFKTRTFKSTYEIDWENHKVKLLDTKETENNK

SEQ ID NO: 31452 - protein, 426 aa, Staphylococcus aureus; identical to SEQ ID NO: 31416
  strain Mu50 / ATCC 700699

SEQ ID NO: 31453 - protein, 351 aa, Staphylococcus aureus
  strain Mu50 / ATCC 700699
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPSILEKNKDGQRLIVTYEVDWKNKTVKVVDKYSDDNKPYKEG

SEQ ID NO: 31454 - protein, 289 aa, Staphylococcus aureus; identical to SEQ ID NO: 31405
  strain Mu50 / ATCC 700699

SEQ ID NO: 31455 - protein, 260 aa, Staphylococcus aureus; identical to SEQ ID NO: 31068
  strain Mu50 / ATCC 700699

SEQ ID NO: 31456 - protein, 116 aa, Staphylococcus aureus; identical to SEQ ID NO: 31223
  strain Mu50 / ATCC 700699

SEQ ID NO: 31457 - protein, 327 aa, Staphylococcus aureus; identical to SEQ ID NO: 30616
  strain Mu50 / ATCC 700699

SEQ ID NO: 31458 - protein, 1983 aa, Staphylococcus aureus; identical to SEQ ID NO: 31387
  strain Mu50 / ATCC 700699

SEQ ID NO: 31459 - protein, 891 aa, Staphylococcus aureus; identical to SEQ ID NO: 30788
  strain Mu50 / ATCC 700699

SEQ ID NO: 31460 - protein, 241 aa, Staphylococcus aureus
  strain Mu50 / ATCC 700699
MNNNITKKIILSTTLLLLGTAFTQFPNTPINSSSEAKAYYINQNETNVNELTKYYSQKYLTFSNSTLWQKDNGTIHATSLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGTDNNYTIDLSKRLPSTDANRYVKKPQNAKIEVILEKSN

SEQ ID NO: 31461 - protein, 1248 aa, Staphylococcus aureus
  strain Mu50 / ATCC 700699
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSEHQINPELIKSAAKPAALETQYKAAAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQFTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKSGTKLYTVPWGTSKQVAGSVSGSGNQTFKASKQQQIDKSIYLYGSVNGKSGWVSKAYLVDTAKPTPTPIPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 31462 - protein, 935 aa, Staphylococcus aureus; identical to SEQ ID NO: 31371
  strain Mu50 / ATCC 700699

SEQ ID NO: 31463 - protein, 1141 aa, Staphylococcus aureus; identical to SEQ ID NO: 31369
  strain Mu50 / ATCC 700699

SEQ ID NO: 31464 - protein, 231 aa, Staphylococcus aureus; identical to SEQ ID NO: 31358
  strain Mu50 / ATCC 700699

SEQ ID NO: 31465 - protein, 2481 aa, Staphylococcus aureus; identical to SEQ ID NO: 31413
  strain Mu50 / ATCC 700699

SEQ ID NO: 31466 - protein, 106 aa, Staphylococcus aureus; identical to SEQ ID NO: 30624
  strain Mu50 / ATCC 700699

SEQ ID NO: 31467 - protein, 290 aa, Staphylococcus aureus
  strain Mu50 / ATCC 700699
MKYRKLIILVLSILIILPVSTLDGHHIANADDDSPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDLHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKD

SEQ ID NO: 31468 - protein, 2271 aa, Staphylococcus aureus; identical to SEQ ID NO: 30597
  strain Mu50 / ATCC 700699

SEQ ID NO: 31469 - protein, 877 aa, Staphylococcus aureus; identical to SEQ ID NO: 30593
  strain Mu50 / ATCC 700699

SEQ ID NO: 31470 - protein, 211 aa, Staphylococcus aureus; identical to SEQ ID NO: 31425
  strain Mu50 / ATCC 700699

SEQ ID NO: 31471 - protein, 1038 aa, Staphylococcus aureus; identical to SEQ ID NO: 31423
  strain Mu50 / ATCC 700699

SEQ ID NO: 31472 - protein, 961 aa, Staphylococcus aureus; identical to SEQ ID NO: 30589
  strain Mu50 / ATCC 700699

SEQ ID NO: 31473 - protein, 315 aa, Staphylococcus aureus; identical to SEQ ID NO: 30573
  strain Mu50 / ATCC 700699

SEQ ID NO: 31474 - protein, 267 aa, Staphylococcus aureus; identical to SEQ ID NO: 30714
  strain Mu50 / ATCC 700699

SEQ ID NO: 31475 - protein, 141 aa, Staphylococcus aureus; identical to SEQ ID NO: 30633
  strain Mu50 / ATCC 700699

SEQ ID NO: 31476 - protein, 809 aa, Staphylococcus aureus; identical to SEQ ID NO: 30632
  strain Mu50 / ATCC 700699

SEQ ID NO: 31477 - protein, 231 aa, Staphylococcus aureus; identical to SEQ ID NO: 30630
  strain Mu50 / ATCC 700699

SEQ ID NO: 31478 - protein, 338 aa, Staphylococcus aureus; identical to SEQ ID NO: 30627
  strain Mu50 / ATCC 700699

SEQ ID NO: 31479 - protein, 260 aa, Staphylococcus aureus; identical to SEQ ID NO: 30623
  strain Mu50 / ATCC 700699

SEQ ID NO: 31480 - protein, 239 aa, Staphylococcus aureus; identical to SEQ ID NO: 30622
  strain Mu50 / ATCC 700699

SEQ ID NO: 31481 - protein, 136 aa, Staphylococcus aureus; identical to SEQ ID NO: 30620
  strain Mu50 / ATCC 700699

SEQ ID NO: 31482 - protein, 311 aa, Staphylococcus aureus; identical to SEQ ID NO: 30617
  strain Mu50 / ATCC 700699

SEQ ID NO: 31483 - protein, 235 aa, Staphylococcus aureus; identical to SEQ ID NO: 30942
  strain Mu50 / ATCC 700699

SEQ ID NO: 31484 - protein, 239 aa, Staphylococcus aureus; identical to SEQ ID NO: 31389
  strain Mu50 / ATCC 700699

SEQ ID NO: 31485 - protein, 331 aa, Staphylococcus aureus; identical to SEQ ID NO: 30615
  strain Mu50 / ATCC 700699

SEQ ID NO: 31486 - protein, 157 aa, Staphylococcus aureus; identical to SEQ ID NO: 30611
  strain Mu50 / ATCC 700699

SEQ ID NO: 31487 - protein, 62 aa, Staphylococcus aureus; identical to SEQ ID NO: 30610
  strain Mu50 / ATCC 700699

SEQ ID NO: 31488 - protein, 383 aa, Staphylococcus aureus
  strain Mu50 / ATCC 700699
MFIYYCKECSIMNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31489 - protein, 241 aa, Staphylococcus aureus; identical to SEQ ID NO: 30608
  strain Mu50 / ATCC 700699

SEQ ID NO: 31490 - protein, 238 aa, Staphylococcus aureus; identical to SEQ ID NO: 30606
  strain Mu50 / ATCC 700699

SEQ ID NO: 31491 - protein, 319 aa, Staphylococcus aureus; identical to SEQ ID NO: 30605
  strain Mu50 / ATCC 700699

SEQ ID NO: 31492 - protein, 133 aa, Staphylococcus aureus
  strain Mu50 / ATCC 700699
MKKNITKTIIASTVIAAGLLTQTNDAKAFFSYEWKGLEIAKNLADQAKKDDERIDKLMKESDKNLTPYKAETVNDLYLIVKKLSQGDVKKAVVRIKDGGPRDYYTFDLTRPLEENRKNIKVVKNGEIDSIYWD

SEQ ID NO: 31493 - protein, 109 aa, Staphylococcus aureus; identical to SEQ ID NO: 30603
  strain Mu50 / ATCC 700699

SEQ ID NO: 31494 - protein, 227 aa, Staphylococcus aureus; identical to SEQ ID NO: 30927
  strain Mu50 / ATCC 700699

SEQ ID NO: 31495 - protein, 350 aa, Staphylococcus aureus; identical to SEQ ID NO: 30602
  strain Mu50 / ATCC 700699

SEQ ID NO: 31496 - protein, 645 aa, Staphylococcus aureus; identical to SEQ ID NO: 30601
  strain Mu50 / ATCC 700699

SEQ ID NO: 31497 - protein, 342 aa, Staphylococcus aureus
  strain Mu50 / ATCC 700699
MKGKFLKVSSLFVATLTTATLVSSPAANALSSKAMDNHPQQTQSSKQQTPKIKKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDNPNNPDEPNNPDNPNNPDNPDNGDNNNSDNPDAA

SEQ ID NO: 31498 - protein, 393 aa, Staphylococcus aureus
  strain Mu50 / ATCC 700699
MNSSYKSRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLPGNVKEKESAKTVSAKLKQELKNTVTPTKVEENEAIQEDQVQYENTLKNFKIREQQFDNSWCAGFSMAALLNATKNTDTYNAHDIMRTLYPEVSEQDLPNCSTFPNQMIEYGKSQGRDIHYQEGVPSYEQVDQLTKDNVGIMILAQSVSQNPNDPHLGHALAVVGNAKINDQEKLIYWNPWDTELSIQDADSSLLHLSFNRDYNWYGSMIGY

SEQ ID NO: 31499 - protein, 228 aa, Staphylococcus aureus
  strain Mu50 / ATCC 700699
MTEYLLSAGICMAIVSILLIGMAISNVSKGQYAKRFFFFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENANKIEVEFDKGQRTDKYGRGLAYIYADGKMVNEALVRQGLAKVAYVYKPNNTHEQLLRKSEAQAKKEKLNIWSEDNADSGQ

SEQ ID NO: 31500 - protein, 646 aa, Staphylococcus aureus; identical to SEQ ID NO: 30757
  strain Mu50 / ATCC 700699

SEQ ID NO: 31501 - protein, 254 aa, Staphylococcus aureus; identical to SEQ ID NO: 30556
  strain Mu50 / ATCC 700699

SEQ ID NO: 31502 - protein, 1385 aa, Staphylococcus aureus; identical to SEQ ID NO: 30595
  strain Mu50 / ATCC 700699

SEQ ID NO: 31503 - protein, 953 aa, Staphylococcus aureus; identical to SEQ ID NO: 30594
  strain Mu50 / ATCC 700699

SEQ ID NO: 31504 - protein, 227 aa, Staphylococcus aureus; identical to SEQ ID NO: 30586
  strain Mu50 / ATCC 700699

SEQ ID NO: 31505 - protein, 227 aa, Staphylococcus aureus; identical to SEQ ID NO: 30585
  strain Mu50 / ATCC 700699

SEQ ID NO: 31506 - protein, 232 aa, Staphylococcus aureus; identical to SEQ ID NO: 30584
  strain Mu50 / ATCC 700699

SEQ ID NO: 31507 - protein, 232 aa, Staphylococcus aureus; identical to SEQ ID NO: 30583
  strain Mu50 / ATCC 700699

SEQ ID NO: 31508 - protein, 231 aa, Staphylococcus aureus; identical to SEQ ID NO: 30582
  strain Mu50 / ATCC 700699

SEQ ID NO: 31509 - protein, 234 aa, Staphylococcus aureus; identical to SEQ ID NO: 30581
  strain Mu50 / ATCC 700699

SEQ ID NO: 31510 - protein, 356 aa, Staphylococcus aureus; identical to SEQ ID NO: 30793
  strain Mu50 / ATCC 700699

SEQ ID NO: 31511 - protein, 226 aa, Staphylococcus aureus; identical to SEQ ID NO: 30577
  strain Mu50 / ATCC 700699

SEQ ID NO: 31512 - protein, 203 aa, Staphylococcus aureus; identical to SEQ ID NO: 30576
  strain Mu50 / ATCC 700699

SEQ ID NO: 31513 - protein, 691 aa, Staphylococcus aureus; identical to SEQ ID NO: 30511
  strain Mu50 / ATCC 700699

SEQ ID NO: 31514 - protein, 104 aa, Staphylococcus aureus
  strain Mu50 / ATCC 700699
MGGYKGIKADGGKVNQAKQLAAKIAKDIEACQKQTQQLAEYIEGSDWEGQFANKVKDVLLIMAKFQEELVQPMADHQKAIDNLSQNLAKYDTLSIKQGLDRVNP

SEQ ID NO: 31515 - protein, 130 aa, Staphylococcus aureus
  strain Mu50 / ATCC 700699
MNFNDIETMVKSKFKDIKKHAEEIAHEIEVRSGYLRKAEQYKRLEFNLSIALDDVESTAKDVQTAKSSANKDSVSVKGKAPNTLYIEKRNLMKQKLEMLGEDIDKNKESLQKAKGIAGEKASEYFNKAMN

SEQ ID NO: 31516 - protein, 97 aa, Staphylococcus aureus; identical to SEQ ID NO: 30774
  strain Mu50 / ATCC 700699

SEQ ID NO: 31517 - protein, 316 aa, Staphylococcus aureus
  strain Mu50 / ATCC 700699
MKKLTAAAIATMGFATFTMAHQADAAETTNTQQAHTLMSTQSQDVSYGTYYTIDSNGDYHHTPDGNWNQAMFDNKEYSYTFVDAQGHTHYFYNCYPKNANANGSGQTYVNPATAGDNNDYTASQSQQHINQYGYQSNVGPDASYYSHSNNNQAYNSHDGNGKVNYPNGTSNQNGGSASKATASGHAKDASWLTSRKQLQPYGQYHGGGAHYGVDYAMPENSPVYSLTDGTVVQAGWSNYGGGNQVTIKEANSNNYQWYMHNNRLTVSAGDKVKAGDQIAYSGSTGNSTAPHVHFQRMSGGIGNQYAVDPTSYLQSR

SEQ ID NO: 31518 - protein, 241 aa, Staphylococcus aureus; identical to SEQ ID NO: 30571
  strain Mu50 / ATCC 700699

SEQ ID NO: 31519 - protein, 309 aa, Staphylococcus aureus; identical to SEQ ID NO: 30406
  strain MW2

SEQ ID NO: 31520 - protein, 325 aa, Staphylococcus aureus; identical to SEQ ID NO: 30407
  strain MW2

SEQ ID NO: 31521 - protein, 257 aa, Staphylococcus aureus; identical to SEQ ID NO: 30259
  strain MW2

SEQ ID NO: 31522 - protein, 241 aa, Staphylococcus aureus; identical to SEQ ID NO: 30411
  strain MW2

SEQ ID NO: 31523 - protein, 233 aa, Staphylococcus aureus; identical to SEQ ID NO: 30428
  strain MW2

SEQ ID NO: 31524 - protein, 434 aa, Staphylococcus aureus [sequence omitted]

SEQ ID NO: 31525 - protein, 175 aa, Staphylococcus aureus; identical to SEQ ID NO: 30554
  strain MW2

SEQ ID NO: 31526 - protein, 255 aa, Staphylococcus aureus; identical to SEQ ID NO: 30706
  strain MW2

SEQ ID NO: 31527 - protein, 315 aa, Staphylococcus aureus; identical to SEQ ID NO: 30573
  strain MW2

SEQ ID NO: 31528 - protein, 141 aa, Staphylococcus aureus; identical to SEQ ID NO: 30633
  strain MW2

SEQ ID NO: 31529 - protein, 116 aa, Staphylococcus aureus; identical to SEQ ID NO: 31223
  strain MW2

SEQ ID NO: 31530 - protein, 311 aa, Staphylococcus aureus; identical to SEQ ID NO: 30617
  strain MW2

SEQ ID NO: 31531 - protein, 327 aa, Staphylococcus aureus; identical to SEQ ID NO: 30538
  strain MW2

SEQ ID NO: 31532 - protein, 291 aa, Staphylococcus aureus; identical to SEQ ID NO: 30390
  strain MW2

SEQ ID NO: 31533 - protein, 383 aa, Staphylococcus aureus; identical to SEQ ID NO: 31310
  strain MW2

SEQ ID NO: 31534 - protein, 227 aa, Staphylococcus aureus; identical to SEQ ID NO: 30927
  strain MW2

SEQ ID NO: 31535 - protein, 350 aa, Staphylococcus aureus; identical to SEQ ID NO: 30602
  strain MW2

SEQ ID NO: 31536 - protein, 646 aa, Staphylococcus aureus; identical to SEQ ID NO: 30757
  strain MW2

SEQ ID NO: 31537 - protein, 334 aa, Staphylococcus aureus; identical to SEQ ID NO: 30414
  strain MW2

SEQ ID NO: 31538 - protein, 97 aa, Staphylococcus aureus; identical to SEQ ID NO: 30774
  strain MW2

SEQ ID NO: 31539 - protein, 1183 aa, Staphylococcus aureus
  strain MW2
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKAVDVTSETNWKYEFKDLPKYDEGKKIEYTVTEDHVKDYTTDINGTTITNKYTPGETSATVTKNWDDNNNQDGKRPTEIKVELYQDGKATGKTAKLNESNNWTHTWTGLDEKAKGQQVKYTVEELTKVKGYTTHVDNNDMGNLIVTNKYTPETTSINGEKVWDDKDNQDGKRPEKVSINLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVKAVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31540 - protein, 680 aa, Staphylococcus aureus; identical to SEQ ID NO: 30700
  strain MW2

SEQ ID NO: 31541 - protein, 290 aa, Staphylococcus aureus; identical to SEQ ID NO: 31273
  strain MW2

SEQ ID NO: 31542 - protein, 2275 aa, Staphylococcus aureus
  strain MW2
MSKRQKEFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSASLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSASISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 31543 - protein, 907 aa, Staphylococcus aureus
  strain MW2
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 31544 - protein, 198 aa, Staphylococcus aureus
  strain MW2
MLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 31545 - protein, 1015 aa, Staphylococcus aureus; identical to SEQ ID NO: 31279
  strain MW2

SEQ ID NO: 31546 - protein, 943 aa, Staphylococcus aureus
  strain MW2
MKSNLRYGIRKHKLGAASVFLGTMIVVGMGQEKEAAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAERVTLKYKWKFEDGIKPGDYFDFTLSNNVETHGISPLRKVPDIKSKDDNILAVGKVMDERKIRYTFTDYINNKNNLMAELNLNLFIDPTTVTKQGKQTVEVKLGENKISKEFDIKYLDGVKDNWGVTVNGRITLLDKENSKIHHLAYINPKKSDMTSITINGFFAKGGLYTGNVPTVKVYEYLRSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNDPIIEKSEPIELDIKSEPPVEKHELTGTIEESNDSKPIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVDFEEDTLPQVSGHNEGQQTIEEDTTLPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 31547 - protein, 1371 aa, Staphylococcus aureus
  strain MW2
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPIDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPIDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 31548 - protein, 437 aa, Staphylococcus aureus; identical to SEQ ID NO: 31285
  strain MW2

SEQ ID NO: 31549 - protein, 269 aa, Staphylococcus aureus; identical to SEQ ID NO: 31286
  strain MW2

SEQ ID NO: 31550 - protein, 815 aa, Staphylococcus aureus; identical to SEQ ID NO: 31288
  strain MW2

SEQ ID NO: 31551 - protein, 231 aa, Staphylococcus aureus; identical to SEQ ID NO: 31073
  strain MW2

SEQ ID NO: 31552 - protein, 26 aa, Staphylococcus aureus
  strain MW2
MAQDIISTISDLVKWIIDTVNKFTKK

SEQ ID NO: 31553 - protein, 350 aa, Staphylococcus aureus; identical to SEQ ID NO: 31291
  strain MW2

SEQ ID NO: 31554 - protein, 338 aa, Staphylococcus aureus; identical to SEQ ID NO: 31292
  strain MW2

SEQ ID NO: 31555 - protein, 274 aa, Staphylococcus aureus; identical to SEQ ID NO: 30872
  strain MW2

SEQ ID NO: 31556 - protein, 242 aa, Staphylococcus aureus; identical to SEQ ID NO: 31293
  strain MW2

SEQ ID NO: 31557 - protein, 242 aa, Staphylococcus aureus; identical to SEQ ID NO: 31294
  strain MW2

SEQ ID NO: 31558 - protein, 163 aa, Staphylococcus aureus
  strain MW2
MLKRSLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDTSAKIEVTYYDKNKKKEETKSFPITEKGFVVPDLSEHIKNPGFNLITKVVIEKK

SEQ ID NO: 31559 - protein, 96 aa, Staphylococcus aureus
  strain MW2
MKFPVTINKFENIVSNEFVFYNASKITINDLSIKLKSAIANDQGITKHDIELAERAVYKVYFKNGSSKYVDLKTEYKDERVFKATDIKKVDIELKF

SEQ ID NO: 31560 - protein, 388 aa, Staphylococcus aureus; identical to SEQ ID NO: 31298
  strain MW2

SEQ ID NO: 31561 - protein, 235 aa, Staphylococcus aureus; identical to SEQ ID NO: 31301
  strain MW2

SEQ ID NO: 31562 - protein, 240 aa, Staphylococcus aureus; identical to SEQ ID NO: 31302
  strain MW2

SEQ ID NO: 31563 - protein, 239 aa, Staphylococcus aureus
  strain MW2
MNKNIVIKSMAALAILTSVTGINAAVVEETQQIANAEKNVTQVKDTNIFPYNGVVSFKDATGFVIGKNTIITNKHVSKDYKVGDRITAHPDGDKGNGGIYKIKSISDYPGDEDISVMNIEEQAVERGPKGFNFNENVQALNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 31564 - protein, 239 aa, Staphylococcus aureus; identical to SEQ ID NO: 31304
  strain MW2

SEQ ID NO: 31565 - protein, 331 aa, Staphylococcus aureus; identical to SEQ ID NO: 31305
  strain MW2

SEQ ID NO: 31566 - protein, 2186 aa, Staphylococcus aureus
  strain MW2
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGSVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNKKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVISRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEAMKVSPKVIQPAPKVCTPIKKEETHESRKVEKELPNTGSEEMDLPLKEFALITGAALLARRRTKNEKES

SEQ ID NO: 31567 - protein, 895 aa, Staphylococcus aureus; identical to SEQ ID NO: 31307
  strain MW2

SEQ ID NO: 31568 - protein, 229 aa, Staphylococcus aureus; identical to SEQ ID NO: 31309
  strain MW2

SEQ ID NO: 31569 - protein, 312 aa, Staphylococcus aureus; identical to SEQ ID NO: 30196
  strain MW2

SEQ ID NO: 31570 - protein, 325 aa, Staphylococcus aureus; identical to SEQ ID NO: 30484
  strain MW2

SEQ ID NO: 31571 - protein, 241 aa, Staphylococcus aureus; identical to SEQ ID NO: 31311
  strain MW2

SEQ ID NO: 31572 - protein, 241 aa, Staphylococcus aureus; identical to SEQ ID NO: 30739
  strain MW2

SEQ ID NO: 31573 - protein, 238 aa, Staphylococcus aureus; identical to SEQ ID NO: 31313
  strain MW2

SEQ ID NO: 31574 - protein, 319 aa, Staphylococcus aureus; identical to SEQ ID NO: 30495
  strain MW2

SEQ ID NO: 31575 - protein, 165 aa, Staphylococcus aureus; identical to SEQ ID NO: 31315
  strain MW2

SEQ ID NO: 31576 - protein, 132 aa, Staphylococcus aureus; identical to SEQ ID NO: 31316
  strain MW2

SEQ ID NO: 31577 - protein, 105 aa, Staphylococcus aureus; identical to SEQ ID NO: 31317
  strain MW2

SEQ ID NO: 31578 - protein, 645 aa, Staphylococcus aureus; identical to SEQ ID NO: 30747
  strain MW2

SEQ ID NO: 31579 - protein, 1256 aa, Staphylococcus aureus
  strain MW2
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKAAAPKAATTSAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDIDWANINAKIIKGYYDKIGEVGKYFDIPQYK

SEQ ID NO: 31580 - protein, 327 aa, Staphylococcus aureus
  strain MW2
MKGKFLKVSSLFVATLTTATLVSSPAANALSSKAMDNHPQQSQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPNNPDNPDNGDNNNSDNPDAA

SEQ ID NO: 31581 - protein, 393 aa, Staphylococcus aureus; identical to SEQ ID NO: 31323
  strain MW2

SEQ ID NO: 31582 - protein, 228 aa, Staphylococcus aureus; identical to SEQ ID NO: 31324
  strain MW2

SEQ ID NO: 31583 - protein, 946 aa, Staphylococcus aureus
  strain MW2
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 31584 - protein, 240 aa, Staphylococcus aureus
  strain MW2
MKKRLLFVIVITLFIFSSNHTVLSNGDVGPGNLRNFYTKYEYVNLKNVKDKNSPESHRLEYSYKNDTLYAEFDNEYITSDLKGKNVDVFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHINDGSNFSYDLFYTGYGLPESFLKIYKDNKTVDSTQFHLDVEISKR

SEQ ID NO: 31585 - protein, 266 aa, Staphylococcus aureus
  strain MW2
MNKSRFISCVILIFALILVLFTPNVLAESQPDPTPDELHKSSEFTGTMGNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKRVKIEVHLTTKNG

SEQ ID NO: 31586 - protein, 254 aa, Staphylococcus aureus
  strain MW2
MTVEERSNTAKVDILGVDFDNTTMLQMVENIKTFFANQSTNNLFIVTANPEIVNYATTHQAYLELINQASYIVADGTGVVKASHRLKQPLAHRIPGIELMDECLKIAHVNHQKVFLLGATNEVVEAAQYALQQRYPNISFAHHHGYIDLEDETVVKRIKLFKPDYIFVGMGFPKQEEWIMTHENQFESTVMMGVGGSLEVFAGAKKRAPYIFRKLNIEWIYRALMDWKRIGRLKSIPIFMYKIAKAKRKIKKAK

SEQ ID NO: 31587 - protein, 1141 aa, Staphylococcus aureus; identical to SEQ ID NO: 31329
  strain MW2

SEQ ID NO: 31588 - protein, 1347 aa, Staphylococcus aureus
  strain MW2
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYINPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTSKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 31589 - protein, 955 aa, Staphylococcus aureus
  strain MW2
MNNKKTVTNRKGMIPNRLNKFSIRKYSVGTASILVGTTLIFGLSGHEAKAAEHTNGELNQSKNETTAPSENKTTEKVDSHQLKDNTQTATADQPKVTMSDSATFKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVSLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 31590 - protein, 230 aa, Staphylococcus aureus; identical to SEQ ID NO: 31333
  strain MW2

SEQ ID NO: 31591 - protein, 227 aa, Staphylococcus aureus; identical to SEQ ID NO: 31334
  strain MW2

SEQ ID NO: 31592 - protein, 232 aa, Staphylococcus aureus; identical to SEQ ID NO: 31335
  strain MW2

SEQ ID NO: 31593 - protein, 232 aa, Staphylococcus aureus
  strain MW2
MKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSYDEFFFIQKEEVSLKELDFKIRKLLIKKYKLYEGAADKGRIVINMKDENKYEIDLSDKLGFERMADVINSEQIKNIEVNLK

SEQ ID NO: 31594 - protein, 231 aa, Staphylococcus aureus; identical to SEQ ID NO: 31337
  strain MW2

SEQ ID NO: 31595 - protein, 232 aa, Staphylococcus aureus; identical to SEQ ID NO: 31338
  strain MW2

SEQ ID NO: 31596 - protein, 234 aa, Staphylococcus aureus; identical to SEQ ID NO: 31339
  strain MW2

SEQ ID NO: 31597 - protein, 315 aa, Staphylococcus aureus; identical to SEQ ID NO: 31340
  strain MW2

SEQ ID NO: 31598 - protein, 356 aa, Staphylococcus aureus
  strain MW2
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTQQTKMTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 31599 - protein, 231 aa, Staphylococcus aureus; identical to SEQ ID NO: 31342
  strain MW2

SEQ ID NO: 31600 - protein, 226 aa, Staphylococcus aureus; identical to SEQ ID NO: 31343
  strain MW2

SEQ ID NO: 31601 - protein, 203 aa, Staphylococcus aureus; identical to SEQ ID NO: 31344
  strain MW2

SEQ ID NO: 31602 - protein, 690 aa, Staphylococcus aureus; identical to SEQ ID NO: 31345
  strain MW2

SEQ ID NO: 31603 - protein, 104 aa, Staphylococcus aureus; identical to SEQ ID NO: 31346
  strain MW2

SEQ ID NO: 31604 - protein, 130 aa, Staphylococcus aureus; identical to SEQ ID NO: 31347
  strain MW2

SEQ ID NO: 31605 - protein, 316 aa, Staphylococcus aureus; identical to SEQ ID NO: 31349
  strain MW2

SEQ ID NO: 31606 - protein, 241 aa, Staphylococcus aureus; identical to SEQ ID NO: 31350
  strain MW2

SEQ ID NO: 31607 - protein, 492 aa, Staphylococcus aureus; identical to SEQ ID NO: 31351
  strain MW2

SEQ ID NO: 31608 - protein, 62 aa, Staphylococcus aureus
  strain MW2
MYDSETGDIQKGYIKFHSTKSSFYYDLFDFKVKKRVDFLKFYNDNELISTKKLHIDIYLFNK

SEQ ID NO: 31609 - protein, 309 aa, Staphylococcus aureus; identical to SEQ ID NO: 30406
  strain N315

SEQ ID NO: 31610 - protein, 325 aa, Staphylococcus aureus; identical to SEQ ID NO: 30407
  strain N315

SEQ ID NO: 31611 - protein, 266 aa, Staphylococcus aureus; identical to SEQ ID NO: 30409
  strain N315

SEQ ID NO: 31612 - protein, 258 aa, Staphylococcus aureus; identical to SEQ ID NO: 30410
  strain N315

SEQ ID NO: 31613 - protein, 26 aa, Staphylococcus aureus
  strain N315
MAQDIISTIGDLVKWIIDTVNKFTKK

SEQ ID NO: 31614 - protein, 1370 aa, Staphylococcus aureus
  strain N315
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPSAKNNNRIRKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 31615 - protein, 680 aa, Staphylococcus aureus; identical to SEQ ID NO: 30845
  strain N315

SEQ ID NO: 31616 - protein, 388 aa, Staphylococcus aureus; identical to SEQ ID NO: 31437
  strain N315

SEQ ID NO: 31617 - protein, 165 aa, Staphylococcus aureus; identical to SEQ ID NO: 30418
  strain N315

SEQ ID NO: 31618 - protein, 434 aa, Staphylococcus aureus [sequence omitted]

SEQ ID NO: 31619 - protein, 450 aa, Staphylococcus aureus; identical to SEQ ID NO: 31353
  strain N315

SEQ ID NO: 31620 - protein, 233 aa, Staphylococcus aureus; identical to SEQ ID NO: 30591
  strain N315

SEQ ID NO: 31621 - protein, 290 aa, Staphylococcus aureus; identical to SEQ ID NO: 31467
  strain N315

SEQ ID NO: 31622 - protein, 2271 aa, Staphylococcus aureus; identical to SEQ ID NO: 30597
  strain N315

SEQ ID NO: 31623 - protein, 175 aa, Staphylococcus aureus; identical to SEQ ID NO: 30554
  strain N315

SEQ ID NO: 31624 - protein, 877 aa, Staphylococcus aureus; identical to SEQ ID NO: 30593
  strain N315

SEQ ID NO: 31625 - protein, 211 aa, Staphylococcus aureus; identical to SEQ ID NO: 31425
  strain N315

SEQ ID NO: 31626 - protein, 255 aa, Staphylococcus aureus; identical to SEQ ID NO: 30706
  strain N315

SEQ ID NO: 31627 - protein, 1038 aa, Staphylococcus aureus; identical to SEQ ID NO: 31423
  strain N315

SEQ ID NO: 31628 - protein, 961 aa, Staphylococcus aureus; identical to SEQ ID NO: 30589
  strain N315

SEQ ID NO: 31629 - protein, 315 aa, Staphylococcus aureus; identical to SEQ ID NO: 30573
  strain N315

SEQ ID NO: 31630 - protein, 267 aa, Staphylococcus aureus; identical to SEQ ID NO: 30714
  strain N315

SEQ ID NO: 31631 - protein, 141 aa, Staphylococcus aureus; identical to SEQ ID NO: 30633
  strain N315

SEQ ID NO: 31632 - protein, 809 aa, Staphylococcus aureus; identical to SEQ ID NO: 30632
  strain N315

SEQ ID NO: 31633 - protein, 2481 aa, Staphylococcus aureus; identical to SEQ ID NO: 31413
  strain N315

SEQ ID NO: 31634 - protein, 231 aa, Staphylococcus aureus; identical to SEQ ID NO: 30630
  strain N315

SEQ ID NO: 31635 - protein, 234 aa, Staphylococcus aureus; identical to SEQ ID NO: 30395
  strain N315

SEQ ID NO: 31636 - protein, 240 aa, Staphylococcus aureus; identical to SEQ ID NO: 30548
  strain N315

SEQ ID NO: 31637 - protein, 338 aa, Staphylococcus aureus; identical to SEQ ID NO: 30627
  strain N315

SEQ ID NO: 31638 - protein, 260 aa, Staphylococcus aureus; identical to SEQ ID NO: 30623
  strain N315

SEQ ID NO: 31639 - protein, 239 aa, Staphylococcus aureus; identical to SEQ ID NO: 30622
  strain N315

SEQ ID NO: 31640 - protein, 242 aa, Staphylococcus aureus; identical to SEQ ID NO: 30399
  strain N315

SEQ ID NO: 31641 - protein, 136 aa, Staphylococcus aureus; identical to SEQ ID NO: 30620
  strain N315

SEQ ID NO: 31642 - protein, 258 aa, Staphylococcus aureus; identical to SEQ ID NO: 30542
  strain N315

SEQ ID NO: 31643 - protein, 311 aa, Staphylococcus aureus; identical to SEQ ID NO: 30617
  strain N315

SEQ ID NO: 31644 - protein, 235 aa, Staphylococcus aureus; identical to SEQ ID NO: 30942
  strain N315

SEQ ID NO: 31645 - protein, 240 aa, Staphylococcus aureus; identical to SEQ ID NO: 30475
  strain N315

SEQ ID NO: 31646 - protein, 239 aa, Staphylococcus aureus; identical to SEQ ID NO: 30476
  strain N315

SEQ ID NO: 31647 - protein, 239 aa, Staphylococcus aureus; identical to SEQ ID NO: 31390
  strain N315

SEQ ID NO: 31648 - protein, 239 aa, Staphylococcus aureus; identical to SEQ ID NO: 31389
  strain N315

SEQ ID NO: 31649 - protein, 331 aa, Staphylococcus aureus; identical to SEQ ID NO: 30615
  strain N315

SEQ ID NO: 31650 - protein, 291 aa, Staphylococcus aureus; identical to SEQ ID NO: 30390
  strain N315

SEQ ID NO: 31651 - protein, 157 aa, Staphylococcus aureus; identical to SEQ ID NO: 30611
  strain N315

SEQ ID NO: 31652 - protein, 62 aa, Staphylococcus aureus; identical to SEQ ID NO: 30610
  strain N315

SEQ ID NO: 31653 - protein, 383 aa, Staphylococcus aureus; identical to SEQ ID NO: 31488
  strain N315

SEQ ID NO: 31654 - protein, 241 aa, Staphylococcus aureus; identical to SEQ ID NO: 30608
  strain N315

SEQ ID NO: 31655 - protein, 238 aa, Staphylococcus aureus; identical to SEQ ID NO: 30606
  strain N315

SEQ ID NO: 31656 - protein, 319 aa, Staphylococcus aureus; identical to SEQ ID NO: 30605
  strain N315

SEQ ID NO: 31657 - protein, 133 aa, Staphylococcus aureus; identical to SEQ ID NO: 31492
  strain N315

SEQ ID NO: 31658 - protein, 109 aa, Staphylococcus aureus; identical to SEQ ID NO: 30603
  strain N315

SEQ ID NO: 31659 - protein, 227 aa, Staphylococcus aureus; identical to SEQ ID NO: 30927
  strain N315

SEQ ID NO: 31660 - protein, 350 aa, Staphylococcus aureus; identical to SEQ ID NO: 30602
  strain N315

SEQ ID NO: 31661 - protein, 645 aa, Staphylococcus aureus; identical to SEQ ID NO: 30601
  strain N315

SEQ ID NO: 31662 - protein, 342 aa, Staphylococcus aureus; identical to SEQ ID NO: 31497
  strain N315

SEQ ID NO: 31663 - protein, 393 aa, Staphylococcus aureus; identical to SEQ ID NO: 31498
  strain N315

SEQ ID NO: 31664 - protein, 228 aa, Staphylococcus aureus; identical to SEQ ID NO: 31499
  strain N315

SEQ ID NO: 31665 - protein, 646 aa, Staphylococcus aureus; identical to SEQ ID NO: 30757
  strain N315

SEQ ID NO: 31666 - protein, 254 aa, Staphylococcus aureus; identical to SEQ ID NO: 30556
  strain N315

SEQ ID NO: 31667 - protein, 1385 aa, Staphylococcus aureus; identical to SEQ ID NO: 30595
  strain N315

SEQ ID NO: 31668 - protein, 953 aa, Staphylococcus aureus; identical to SEQ ID NO: 30594
  strain N315

SEQ ID NO: 31669 - protein, 334 aa, Staphylococcus aureus; identical to SEQ ID NO: 30414
  strain N315

SEQ ID NO: 31670 - protein, 227 aa, Staphylococcus aureus; identical to SEQ ID NO: 30586
  strain N315

SEQ ID NO: 31671 - protein, 227 aa, Staphylococcus aureus; identical to SEQ ID NO: 30585
  strain N315

SEQ ID NO: 31672 - protein, 232 aa, Staphylococcus aureus; identical to SEQ ID NO: 30584
  strain N315

SEQ ID NO: 31673 - protein, 232 aa, Staphylococcus aureus; identical to SEQ ID NO: 30583
  strain N315

SEQ ID NO: 31674 - protein, 231 aa, Staphylococcus aureus; identical to SEQ ID NO: 30582
  strain N315

SEQ ID NO: 31675 - protein, 234 aa, Staphylococcus aureus; identical to SEQ ID NO: 30581
  strain N315

SEQ ID NO: 31676 - protein, 356 aa, Staphylococcus aureus; identical to SEQ ID NO: 30793
  strain N315

SEQ ID NO: 31677 - protein, 226 aa, Staphylococcus aureus; identical to SEQ ID NO: 30577
  strain N315

SEQ ID NO: 31678 - protein, 203 aa, Staphylococcus aureus; identical to SEQ ID NO: 30576
  strain N315

SEQ ID NO: 31679 - protein, 691 aa, Staphylococcus aureus; identical to SEQ ID NO: 30511
  strain N315

SEQ ID NO: 31680 - protein, 104 aa, Staphylococcus aureus; identical to SEQ ID NO: 31514
  strain N315

SEQ ID NO: 31681 - protein, 130 aa, Staphylococcus aureus; identical to SEQ ID NO: 31515
  strain N315

SEQ ID NO: 31682 - protein, 97 aa, Staphylococcus aureus; identical to SEQ ID NO: 30774
  strain N315

SEQ ID NO: 31683 - protein, 316 aa, Staphylococcus aureus; identical to SEQ ID NO: 31517
  strain N315

SEQ ID NO: 31684 - protein, 241 aa, Staphylococcus aureus; identical to SEQ ID NO: 30571
  strain N315

SEQ ID NO: 31685 - protein, 289 aa, Staphylococcus aureus
  strain N315
MRDSKPNKYCCYKVSMYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 31686 - protein, 436 aa, Staphylococcus aureus; identical to SEQ ID NO: 30958
  strain N315

SEQ ID NO: 31687 - protein, 351 aa, Staphylococcus aureus; identical to SEQ ID NO: 30628
  strain N315

SEQ ID NO: 31688 - protein, 260 aa, Staphylococcus aureus; identical to SEQ ID NO: 30625
  strain N315

SEQ ID NO: 31689 - protein, 163 aa, Staphylococcus aureus
  strain N315
MLKRSLLFLTVLLLLFSFSSITNEVSASSSFDKGKYKKGDDASYFEPTGPYLMVNVTGVDSKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVVIEKK

SEQ ID NO: 31690 - protein, 149 aa, Staphylococcus aureus
  strain N315
MKKKLATTVLALSFLTAGISTHHHSAKAFTFEPFPTNEEIESNKKMLEKEKAYKESFKNSGLPTTLGKLDERLRNYLEKGTKNTAQFEKMVILTENKGYYTVYLNTPLAEDRKNVELLGKMYKTYFFKKGESKSSYVINGPGKTNEYAY

SEQ ID NO: 31691 - protein, 116 aa, Staphylococcus aureus
  strain N315
MKIRKSILAGTLAIVLASPLVTNLDKNEAQASTSLPTSNEYQNEKLANELKSLLDELNVNELATGSLNTYYKRTIKISGLKAMYALKSKDFKKMSEAKYQLQKIYNEIDEALKSKY

SEQ ID NO: 31692 - protein, 327 aa, Staphylococcus aureus; identical to SEQ ID NO: 30616
  strain N315

SEQ ID NO: 31693 - protein, 2186 aa, Staphylococcus aureus; identical to SEQ ID NO: 30516
  strain N315

SEQ ID NO: 31694 - protein, 891 aa, Staphylococcus aureus
  strain N315
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKNVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 31695 - protein, 241 aa, Staphylococcus aureus; identical to SEQ ID NO: 30607
  strain N315

SEQ ID NO: 31696 - protein, 1248 aa, Staphylococcus aureus; identical to SEQ ID NO: 31461
  strain N315

SEQ ID NO: 31697 - protein, 989 aa, Staphylococcus aureus
  strain N315
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 31698 - protein, 1141 aa, Staphylococcus aureus
  strain N315
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31699 - protein, 292 aa, Staphylococcus aureus; identical to SEQ ID NO: 30580
  strain N315

SEQ ID NO: 31700 - protein, 231 aa, Staphylococcus aureus; identical to SEQ ID NO: 30578
  strain N315

SEQ ID NO: 31701 - protein, 559 aa, Staphylococcus aureus
  strain NCTC 8325
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 31702 - protein, 316 aa, Staphylococcus aureus [sequence omitted]

SEQ ID NO: 31703 - protein, 516 aa, Staphylococcus aureus
  strain NCTC 8325
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31704 - protein, 1018 aa, Staphylococcus aureus
  strain NCTC 8325
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 31705 - protein, 680 aa, Staphylococcus aureus; identical to SEQ ID NO: 30700
  strain NCTC 8325

SEQ ID NO: 31706 - protein, 2271 aa, Staphylococcus aureus
  strain NCTC 8325
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLNNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 31707 - protein, 175 aa, Staphylococcus aureus; identical to SEQ ID NO: 30554
  strain NCTC 8325

SEQ ID NO: 31708 - protein, 877 aa, Staphylococcus aureus
  strain NCTC 8325
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 31709 - protein, 233 aa, Staphylococcus aureus; identical to SEQ ID NO: 30428
  strain NCTC 8325

SEQ ID NO: 31710 - protein, 255 aa, Staphylococcus aureus; identical to SEQ ID NO: 30706
  strain NCTC 8325

SEQ ID NO: 31711 - protein, 325 aa, Staphylococcus aureus; identical to SEQ ID NO: 30407
  strain NCTC 8325

SEQ ID NO: 31712 - protein, 315 aa, Staphylococcus aureus; identical to SEQ ID NO: 30440
  strain NCTC 8325

SEQ ID NO: 31713 - protein, 309 aa, Staphylococcus aureus; identical to SEQ ID NO: 30406
  strain NCTC 8325

SEQ ID NO: 31714 - protein, 436 aa, Staphylococcus aureus [sequence omitted]

SEQ ID NO: 31715 - protein, 141 aa, Staphylococcus aureus; identical to SEQ ID NO: 30715
  strain NCTC 8325

SEQ ID NO: 31716 - protein, 2478 aa, Staphylococcus aureus
  strain NCTC 8325
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGDQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 31717 - protein, 231 aa, Staphylococcus aureus; identical to SEQ ID NO: 31073
  strain NCTC 8325

SEQ ID NO: 31718 - protein, 26 aa, Staphylococcus aureus
  strain NCTC 8325
MAQDIISTIGDLVKWIIDTVNKFTKK

SEQ ID NO: 31719 - protein, 351 aa, Staphylococcus aureus; identical to SEQ ID NO: 30720
  strain NCTC 8325

SEQ ID NO: 31720 - protein, 338 aa, Staphylococcus aureus; identical to SEQ ID NO: 30699
  strain NCTC 8325

SEQ ID NO: 31721 - protein, 330 aa, Staphylococcus aureus; identical to SEQ ID NO: 30381
  strain NCTC 8325

SEQ ID NO: 31722 - protein, 149 aa, Staphylococcus aureus
  strain NCTC 8325
MKKKLATTVLALSFLTAGISTHHHSAKAFTFEPFPTNEEIESNKKLLEKEKAYKESFKNSGLPTTLGKLDERLRNYLKKGTKNSAQFEKMVILTENKGYYTVYLNTPLAEDRKNVELLGKMYKTYFFKKGESKSSYVINGPGKTNEYAY

SEQ ID NO: 31723 - protein, 116 aa, Staphylococcus aureus; identical to SEQ ID NO: 31691
  strain NCTC 8325

SEQ ID NO: 31724 - protein, 96 aa, Staphylococcus aureus; identical to SEQ ID NO: 30813
  strain NCTC 8325

SEQ ID NO: 31725 - protein, 306 aa, Staphylococcus aureus; identical to SEQ ID NO: 30803
  strain NCTC 8325

SEQ ID NO: 31726 - protein, 327 aa, Staphylococcus aureus; identical to SEQ ID NO: 30538
  strain NCTC 8325

SEQ ID NO: 31727 - protein, 235 aa, Staphylococcus aureus
  strain NCTC 8325
MNKNVMVKGLTALTILTSLGFAENISNQPHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHELIGILYAGSGKDESEKNFGVYFTPQLKEFIQNNIEK

SEQ ID NO: 31728 - protein, 240 aa, Staphylococcus aureus; identical to SEQ ID NO: 30727
  strain NCTC 8325

SEQ ID NO: 31729 - protein, 239 aa, Staphylococcus aureus; identical to SEQ ID NO: 30728
  strain NCTC 8325

SEQ ID NO: 31730 - protein, 239 aa, Staphylococcus aureus; identical to SEQ ID NO: 31390
  strain NCTC 8325

SEQ ID NO: 31731 - protein, 238 aa, Staphylococcus aureus; identical to SEQ ID NO: 30730
  strain NCTC 8325

SEQ ID NO: 31732 - protein, 239 aa, Staphylococcus aureus; identical to SEQ ID NO: 30731
  strain NCTC 8325

SEQ ID NO: 31733 - protein, 2186 aa, Staphylococcus aureus
  strain NCTC 8325
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKTKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 31734 - protein, 895 aa, Staphylococcus aureus
  strain NCTC 8325
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNISTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 31735 - protein, 291 aa, Staphylococcus aureus; identical to SEQ ID NO: 30390
  strain NCTC 8325

SEQ ID NO: 31736 - protein, 234 aa, Staphylococcus aureus; identical to SEQ ID NO: 30736
  strain NCTC 8325

SEQ ID NO: 31737 - protein, 241 aa, Staphylococcus aureus; identical to SEQ ID NO: 30738
  strain NCTC 8325

SEQ ID NO: 31738 - protein, 241 aa, Staphylococcus aureus; identical to SEQ ID NO: 30739
  strain NCTC 8325

SEQ ID NO: 31739 - protein, 238 aa, Staphylococcus aureus; identical to SEQ ID NO: 30740
  strain NCTC 8325

SEQ ID NO: 31740 - protein, 165 aa, Staphylococcus aureus; identical to SEQ ID NO: 30742
  strain NCTC 8325

SEQ ID NO: 31741 - protein, 133 aa, Staphylococcus aureus; identical to SEQ ID NO: 30743
  strain NCTC 8325

SEQ ID NO: 31742 - protein, 109 aa, Staphylococcus aureus; identical to SEQ ID NO: 30744
  strain NCTC 8325

SEQ ID NO: 31743 - protein, 350 aa, Staphylococcus aureus; identical to SEQ ID NO: 30602
  strain NCTC 8325

SEQ ID NO: 31744 - protein, 645 aa, Staphylococcus aureus; identical to SEQ ID NO: 30747
  strain NCTC 8325

SEQ ID NO: 31745 - protein, 1256 aa, Staphylococcus aureus
  strain NCTC 8325
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYICKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDAKFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 31746 - protein, 336 aa, Staphylococcus aureus; identical to SEQ ID NO: 30415
  strain NCTC 8325

SEQ ID NO: 31747 - protein, 393 aa, Staphylococcus aureus; identical to SEQ ID NO: 30750
  strain NCTC 8325

SEQ ID NO: 31748 - protein, 927 aa, Staphylococcus aureus
  strain NCTC 8325
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 31749 - protein, 434 aa, Staphylococcus aureus [sequence omitted]

SEQ ID NO: 31750 - protein, 646 aa, Staphylococcus aureus; identical to SEQ ID NO: 30757
  strain NCTC 8325

SEQ ID NO: 31751 - protein, 1349 aa, Staphylococcus aureus
  strain NCTC 8325
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31752 - protein, 995 aa, Staphylococcus aureus
  strain NCTC 8325
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 31753 - protein, 334 aa, Staphylococcus aureus; identical to SEQ ID NO: 30414
  strain NCTC 8325

SEQ ID NO: 31754 - protein, 225 aa, Staphylococcus aureus; identical to SEQ ID NO: 30763
  strain NCTC 8325

SEQ ID NO: 31755 - protein, 356 aa, Staphylococcus aureus
  strain NCTC 8325
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 31756 - protein, 231 aa, Staphylococcus aureus; identical to SEQ ID NO: 30768
  strain NCTC 8325

SEQ ID NO: 31757 - protein, 226 aa, Staphylococcus aureus; identical to SEQ ID NO: 30769
  strain NCTC 8325

SEQ ID NO: 31758 - protein, 203 aa, Staphylococcus aureus; identical to SEQ ID NO: 30770
  strain NCTC 8325

SEQ ID NO: 31759 - protein, 690 aa, Staphylococcus aureus; identical to SEQ ID NO: 30419
  strain NCTC 8325

SEQ ID NO: 31760 - protein, 328 aa, Staphylococcus aureus
  strain NCTC 8325
MKKCIKTLFLSIILVVMSGWYHSAHASDSLSKSPENWMSKLDDGKHLTEINIPGSHDSGSFTLKDPVKSVWAKTQDKDYLTQMKSGVRFFDIRGRASADNMISVHHGMVYLHHELGKFLDDAKYYLSAYPNETIVMSMKKDYDSDSKVTKTFEEIFREYYYNNPQYQNLFYTGSNANPTLKETKGKIVLFNRMGGTYIKSGYGADTSGIQWADNATFETKINNGSLNLKVQDEYKDYYDKKVEAVKNLLAKAKTDSNKDNVYVNFLSVASGGSAFNSTYNYASHINPEIAKTIKANGKARTGWLIVDYAGYTWPGYDDIVSEIIDSNK

SEQ ID NO: 31761 - protein, 231 aa, Staphylococcus aureus
  strain NCTC 8325
MKLKTLAKATLVLGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKKLMEEEKLYGAVNNRKGKIVVKMEDDKFYTFELTKKLQPHRMGDTIDGTKIKEINVELEYK

SEQ ID NO: 31762 - protein, 234 aa, Staphylococcus aureus; identical to SEQ ID NO: 31052
  strain NCTC 8325

SEQ ID NO: 31763 - protein, 308 aa, Staphylococcus aureus
  strain NCTC 8325
MKITTIAKTSLALGLLTTGVITTTTQAANATTLSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 31764 - protein, 917 aa, Staphylococcus aureus; identical to SEQ ID NO: 31037
  strain NCTC 8325

SEQ ID NO: 31765 - protein, 319 aa, Staphylococcus aureus; identical to SEQ ID NO: 30741
  strain NCTC 8325

SEQ ID NO: 31766 - protein, 619 aa, Staphylococcus aureus
  strain NCTC 8325
MPKNKILIYLLSTTLVLPTLVSPTAYADTPQKDTTAKTTSHDSKKSNDDETSKDTTSKDIDKADKNNTSNQDNNDKKFKTIDDSTSDSNNIIDFIYKNLPQTNINQLLTKNKYDDNYSLTTLIQNLFNLNSDISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSALDSILDQYSEDAKKTQKDYASQSKKDKNEKSNTKNPQLPTQDELKHKSKPAQSFNNDVNQKDTRATSLFETDPSISNNDDSGQFNVVDSKDTRQFVKSIAKDAHRIGQDNDIYASVMIAQAILESDSGRSALAKSPNHNLFGIKGAFEGNSVPFNTLEADGNQLYSINAGFRKYPSTKESLKDYSDLIKNGIDGNRTIYKPTWKSEADSYKDATSHLSKTYATDPNYAKKLNSIIKHYQLTQFDDERMPDLDKYERSIKDYDDSSDEFKPFREVSDSMPYPHGQCTWYVYNRMKQFGTSISGDLGDAHNWNNRAQYRDYQVSHTPKRHAAVVFEAGQFGADQHYGHVAFVEKVNSDGSIVISESNVKGLGIISHRTINAAAAEELSYITGK

SEQ ID NO: 31767 - protein, 199 aa, Staphylococcus aureus
  strain NCTC 8325
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHEPTATHATRSYAIIKPSNDESKSKYAFIKSSNEPK

SEQ ID NO: 31768 - protein, 1627 aa, Staphylococcus aureus
  strain NCTC 8325
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 31769 - protein, 267 aa, Staphylococcus aureus; identical to SEQ ID NO: 30714
  strain NCTC 8325

SEQ ID NO: 31770 - protein, 388 aa, Staphylococcus aureus
  strain NCTC 8325
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTISPKITKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYINKLENFKIRETQGNNGWCAGYTMSELLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNPWDNGFMTQDAKNNVIPVSNGDHYRWYSSIYGY

SEQ ID NO: 31771 - protein, 227 aa, Staphylococcus aureus; identical to SEQ ID NO: 30585
  strain NCTC 8325

SEQ ID NO: 31772 - protein, 232 aa, Staphylococcus aureus; identical to SEQ ID NO: 30765
  strain NCTC 8325

SEQ ID NO: 31773 - protein, 232 aa, Staphylococcus aureus; identical to SEQ ID NO: 31054
  strain NCTC 8325

SEQ ID NO: 31774 - protein, 231 aa, Staphylococcus aureus; identical to SEQ ID NO: 30560
  strain NCTC 8325

SEQ ID NO: 31775 - protein, 331 aa, Staphylococcus aureus; identical to SEQ ID NO: 30732
  strain NCTC 8325

SEQ ID NO: 31776 - protein, 807 aa, Staphylococcus aureus; identical to SEQ ID NO: 30716
  strain NCTC 8325

SEQ ID NO: 31777 - protein, 227 aa, Staphylococcus aureus; identical to SEQ ID NO: 30927
  strain NCTC 8325

SEQ ID NO: 31778 - protein, 290 aa, Staphylococcus aureus; identical to SEQ ID NO: 31273
  strain NCTC 8325

SEQ ID NO: 31779 - protein, 383 aa, Staphylococcus aureus
  strain NCTC 8325
MFVYYCKECFIMNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 31780 - protein, 520 aa, Staphylococcus aureus
  strain Newman
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31781 - protein, 241 aa, Staphylococcus aureus; identical to SEQ ID NO: 30776
  strain Newman

SEQ ID NO: 31782 - protein, 644 aa, Staphylococcus aureus
  strain Newman
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWD

SEQ ID NO: 31783 - protein, 203 aa, Staphylococcus aureus; identical to SEQ ID NO: 30770
  strain Newman

SEQ ID NO: 31784 - protein, 226 aa, Staphylococcus aureus; identical to SEQ ID NO: 30769
  strain Newman

SEQ ID NO: 31785 - protein, 231 aa, Staphylococcus aureus; identical to SEQ ID NO: 30768
  strain Newman

SEQ ID NO: 31786 - protein, 352 aa, Staphylococcus aureus; identical to SEQ ID NO: 30767
  strain Newman

SEQ ID NO: 31787 - protein, 308 aa, Staphylococcus aureus
  strain Newman
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 31788 - protein, 234 aa, Staphylococcus aureus; identical to SEQ ID NO: 31052
  strain Newman

SEQ ID NO: 31789 - protein, 231 aa, Staphylococcus aureus; identical to SEQ ID NO: 31761
  strain Newman

SEQ ID NO: 31790 - protein, 231 aa, Staphylococcus aureus; identical to SEQ ID NO: 30560
  strain Newman

SEQ ID NO: 31791 - protein, 237 aa, Staphylococcus aureus
  strain Newman
MEHMNMKFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 31792 - protein, 232 aa, Staphylococcus aureus; identical to SEQ ID NO: 30765
  strain Newman

SEQ ID NO: 31793 - protein, 227 aa, Staphylococcus aureus; identical to SEQ ID NO: 30585
  strain Newman

SEQ ID NO: 31794 - protein, 225 aa, Staphylococcus aureus; identical to SEQ ID NO: 30763
  strain Newman

SEQ ID NO: 31795 - protein, 434 aa, Staphylococcus aureus [sequence omitted]

SEQ ID NO: 31796 - protein, 645 aa, Staphylococcus aureus; identical to SEQ ID NO: 30747
  strain Newman

SEQ ID NO: 31797 - protein, 350 aa, Staphylococcus aureus; identical to SEQ ID NO: 30602
  strain Newman

SEQ ID NO: 31798 - protein, 227 aa, Staphylococcus aureus; identical to SEQ ID NO: 30927
  strain Newman

SEQ ID NO: 31799 - protein, 109 aa, Staphylococcus aureus; identical to SEQ ID NO: 30744
  strain Newman

SEQ ID NO: 31800 - protein, 133 aa, Staphylococcus aureus
  strain Newman
MKKNITKTIIASTVIAAGLLTQTNDAKAFFSYEWKGLEIAKNLADQAKKDDERIDKLMKESDKNLTPYKAETVNDLYLIVKKLSQGDVKKAVVRIKDDGPRDYYTFDLTRPLEENRKNIKVVKNGEIDSITWY

SEQ ID NO: 31801 - protein, 165 aa, Staphylococcus aureus; identical to SEQ ID NO: 30742
  strain Newman

SEQ ID NO: 31802 - protein, 319 aa, Staphylococcus aureus; identical to SEQ ID NO: 30741
  strain Newman

SEQ ID NO: 31803 - protein, 238 aa, Staphylococcus aureus; identical to SEQ ID NO: 30740
  strain Newman

SEQ ID NO: 31804 - protein, 241 aa, Staphylococcus aureus; identical to SEQ ID NO: 30739
  strain Newman

SEQ ID NO: 31805 - protein, 241 aa, Staphylococcus aureus; identical to SEQ ID NO: 30738
  strain Newman

SEQ ID NO: 31806 - protein, 383 aa, Staphylococcus aureus; identical to SEQ ID NO: 30737
  strain Newman

SEQ ID NO: 31807 - protein, 234 aa, Staphylococcus aureus; identical to SEQ ID NO: 30736
  strain Newman

SEQ ID NO: 31808 - protein, 291 aa, Staphylococcus aureus; identical to SEQ ID NO: 30390
  strain Newman

SEQ ID NO: 31809 - protein, 895 aa, Staphylococcus aureus; identical to SEQ ID NO: 30734
  strain Newman

SEQ ID NO: 31810 - protein, 2186 aa, Staphylococcus aureus; identical to SEQ ID NO: 31059
  strain Newman

SEQ ID NO: 31811 - protein, 331 aa, Staphylococcus aureus; identical to SEQ ID NO: 30732
  strain Newman

SEQ ID NO: 31812 - protein, 239 aa, Staphylococcus aureus; identical to SEQ ID NO: 30731
  strain Newman

SEQ ID NO: 31813 - protein, 238 aa, Staphylococcus aureus; identical to SEQ ID NO: 30730
  strain Newman

SEQ ID NO: 31814 - protein, 239 aa, Staphylococcus aureus; identical to SEQ ID NO: 31390
  strain Newman

SEQ ID NO: 31815 - protein, 239 aa, Staphylococcus aureus; identical to SEQ ID NO: 30728
  strain Newman

SEQ ID NO: 31816 - protein, 240 aa, Staphylococcus aureus; identical to SEQ ID NO: 30727
  strain Newman

SEQ ID NO: 31817 - protein, 238 aa, Staphylococcus aureus; identical to SEQ ID NO: 30726
  strain Newman

SEQ ID NO: 31818 - protein, 327 aa, Staphylococcus aureus; identical to SEQ ID NO: 30538
  strain Newman

SEQ ID NO: 31819 - protein, 311 aa, Staphylococcus aureus; identical to SEQ ID NO: 30617
  strain Newman

SEQ ID NO: 31820 - protein, 116 aa, Staphylococcus aureus; identical to SEQ ID NO: 31223
  strain Newman

SEQ ID NO: 31821 - protein, 149 aa, Staphylococcus aureus [sequence omitted]

SEQ ID NO: 31822 - protein, 257 aa, Staphylococcus aureus; identical to SEQ ID NO: 31220
  strain Newman

SEQ ID NO: 31823 - protein, 274 aa, Staphylococcus aureus; identical to SEQ ID NO: 30872
  strain Newman

SEQ ID NO: 31824 - protein, 338 aa, Staphylococcus aureus; identical to SEQ ID NO: 30699
  strain Newman

SEQ ID NO: 31825 - protein, 351 aa, Staphylococcus aureus; identical to SEQ ID NO: 30720
  strain Newman

SEQ ID NO: 31826 - protein, 231 aa, Staphylococcus aureus; identical to SEQ ID NO: 31073
  strain Newman

SEQ ID NO: 31827 - protein, 2478 aa, Staphylococcus aureus; identical to SEQ ID NO: 30559
  strain Newman

SEQ ID NO: 31828 - protein, 807 aa, Staphylococcus aureus; identical to SEQ ID NO: 30716
  strain Newman

SEQ ID NO: 31829 - protein, 141 aa, Staphylococcus aureus; identical to SEQ ID NO: 30715
  strain Newman

SEQ ID NO: 31830 - protein, 436 aa, Staphylococcus aureus [sequence omitted]

SEQ ID NO: 31831 - protein, 309 aa, Staphylococcus aureus; identical to SEQ ID NO: 30406
  strain Newman

SEQ ID NO: 31832 - protein, 315 aa, Staphylococcus aureus; identical to SEQ ID NO: 30440
  strain Newman

SEQ ID NO: 31833 - protein, 325 aa, Staphylococcus aureus; identical to SEQ ID NO: 30407
  strain Newman

SEQ ID NO: 31834 - protein, 1501 aa, Staphylococcus aureus
  strain Newman
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGKKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 31835 - protein, 128 aa, Staphylococcus aureus
  strain Newman
MPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 31836 - protein, 677 aa, Staphylococcus aureus; identical to SEQ ID NO: 30488
  strain Newman

SEQ ID NO: 31837 - protein, 741 aa, Staphylococcus aureus; identical to SEQ ID NO: 30489
  strain Newman

SEQ ID NO: 31838 - protein, 233 aa, Staphylococcus aureus; identical to SEQ ID NO: 30428
  strain Newman

SEQ ID NO: 31839 - protein, 2271 aa, Staphylococcus aureus
  strain Newman
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 31840 - protein, 680 aa, Staphylococcus aureus; identical to SEQ ID NO: 30700
  strain Newman

SEQ ID NO: 31841 - protein, 44 aa, Staphylococcus aureus; identical to SEQ ID NO: 30513
  strain Newman

SEQ ID NO: 31842 - protein, 913 aa, Staphylococcus aureus; identical to SEQ ID NO: 30704
  strain Newman

SEQ ID NO: 31843 - protein, 947 aa, Staphylococcus aureus
  strain Newman
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 31844 - protein, 1315 aa, Staphylococcus aureus
  strain Newman
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 31845 - protein, 1166 aa, Staphylococcus aureus
  strain Newman
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31846 - protein, 97 aa, Staphylococcus aureus; identical to SEQ ID NO: 30774
  strain Newman

SEQ ID NO: 31847 - protein, 104 aa, Staphylococcus aureus; identical to SEQ ID NO: 30772
  strain Newman

SEQ ID NO: 31848 - protein, 130 aa, Staphylococcus aureus; identical to SEQ ID NO: 30773
  strain Newman

SEQ ID NO: 31849 - protein, 312 aa, Staphylococcus aureus
  strain Newman
MSGWYHSAHASDSLSKSPENWMSKLDDGKHLTEINIPGSHDSGSFTLKDPVKSVWAKTQDKDYLTQMKSGVRFFDIRGRASADNMISVHHGMVYLHHELGKFLDDAKYYLSAYPNETIVMSMKKDYDSDSKVTKTFEEIFREYYYNNPQYQNLFYTGSNANPTLKETKGKIVLFNRMGGTYIKSGYGADTSGIQWADNATFETKINNGSLNLKVQDEYKDYYDKKVEAVKNLLAKAKTDSNKDNVYVNFLSVASGGSAFNSTYNYASHINPEIAKTIKANGKARTGWLIVDYAGYTWPGYDDIVSEIIDSNK

SEQ ID NO: 31850 - protein, 255 aa, Staphylococcus aureus; identical to SEQ ID NO: 30706
  strain Newman

SEQ ID NO: 31851 - protein, 933 aa, Staphylococcus aureus
  strain Newman
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTFNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 31852 - protein, 141 aa, Staphylococcus aureus; identical to SEQ ID NO: 31214
  strain TCH60

SEQ ID NO: 31853 - protein, 808 aa, Staphylococcus aureus
  strain TCH60
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSDISKMKSLMENSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 31854 - protein, 40 aa, Staphylococcus aureus
  strain TCH60
MNLFRQQKFSIRKFNVGIFSALIATVTFISINPTTASAAE

SEQ ID NO: 31855 - protein, 231 aa, Staphylococcus aureus; identical to SEQ ID NO: 31216
  strain TCH60

SEQ ID NO: 31856 - protein, 333 aa, Staphylococcus aureus
  strain TCH60
MLSAANTEANSANKDSQDQTKKEHVDKAQQKEKRNVNDKDKNTPGPDDIGKNGKVTKRTVSEYDKETNILQNLQFDFIDDPTYDKNVLLVKKQGSIHSNLKFESHRNETNASWLKYPSEYHVDFQVQRNPKTEILDQLPKNKISTAKVDSTFSYSLGGKFDSTKGIGRTSSNSYSKSISYNQQNYDTIASGKNNNRHVHWSVVANDLKYGNEIKNRNDEFLFYRNTRLSTVENPELSFASKYRYPALVRSGFNPEFLTYISNEKSNEKTRFEVTYTRNQDILKNKPGIHYGQPILEQNKDGQRFIVVYEVDWKNKTVKVVEKYSDQNKPYKEG

SEQ ID NO: 31857 - protein, 339 aa, Staphylococcus aureus; identical to SEQ ID NO: 31219
  strain TCH60

SEQ ID NO: 31858 - protein, 280 aa, Staphylococcus aureus
  strain TCH60
MIQFQDNVLHWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 31859 - protein, 994 aa, Staphylococcus aureus
  strain TCH60
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSTSDSDSTSDSDSASDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKKIKIRNK

SEQ ID NO: 31860 - protein, 434 aa, Staphylococcus aureus [sequence omitted]

SEQ ID NO: 31861 - protein, 689 aa, Staphylococcus aureus
  strain TCH60
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKANAERYVPYTIAVNGTSTPNLSDLKFKGDSRVSYSDITKKVKSVLKYDRGIGERELKYAKKATYTVHFKNGTKKVINLNSKISQLNLLFVKDIKKIDVDVKTGSKAKADSYVPYTIAVNGTSTPIASKLKLSNKQLIGYQDLNKKVKSVLKHDRGINDIELKFAKQAKYTVHFKNGKTQVVDLKSDIFTRNLFSVKDIKKIDIDVKQHTKSNKALNKVANIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 31862 - protein, 232 aa, Staphylococcus aureus; identical to SEQ ID NO: 31257
  strain TCH60

SEQ ID NO: 31863 - protein, 227 aa, Staphylococcus aureus
  strain TCH60
MKLTALAKVTLALGILTTGTLTTEAHSGHAKQNQKSVNKHDKEALHRYYTGNFKEMKNINALRHGKNNLRFKYRGMNTQVLLPGDEYRKYQQRRHTGLDVFFVQERRDKHDISYTVGGVTKTNKTSGFVSTPRLNVTKEKGEDAFVKGYPYDIKKEEISLKELDFKLRKHLIEKYGLYKTLSKDGRIKISLKDGSFYNLDLRTKLKFKHMGEVIDSKQIKDIEVNLK

SEQ ID NO: 31864 - protein, 232 aa, Staphylococcus aureus; identical to SEQ ID NO: 30565
  strain TCH60

SEQ ID NO: 31865 - protein, 231 aa, Staphylococcus aureus; identical to SEQ ID NO: 30566
  strain TCH60

SEQ ID NO: 31866 - protein, 234 aa, Staphylococcus aureus; identical to SEQ ID NO: 30567
  strain TCH60

SEQ ID NO: 31867 - protein, 325 aa, Staphylococcus aureus
  strain TCH60
MKMTQIAKTSLALSLLTTGASIVTTQSANAEVASALKTEQAIKSKIQKVTTSPSTKVKATQPTPSVTTTTPPSPNVQPQSPQPTPSVTTPSSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 31868 - protein, 343 aa, Staphylococcus aureus; identical to SEQ ID NO: 31263
  strain TCH60

SEQ ID NO: 31869 - protein, 233 aa, Staphylococcus aureus; identical to SEQ ID NO: 31264
  strain TCH60

SEQ ID NO: 31870 - protein, 226 aa, Staphylococcus aureus; identical to SEQ ID NO: 31265
  strain TCH60

SEQ ID NO: 31871 - protein, 265 aa, Staphylococcus aureus
  strain TCH60
MKEGYYKKSKAMLNVLLLIINLIAICSVNNAYANEENPKIEDLCKKSSVDDIALHNIDKDYMTNRFTINESTVLTTEKFLDIDLLFKNFTWLDGKSAEFKDLKVEFSSSEISKEYFGKTVDIYGVYYKAHCHGEHQVKTACTYGGVTPHENNKLSEPKEIGVAVYKDNVNVNTFIVTTDKKKVTAQELDIKVRTKLNNVYKLYDRMTSDVQKGYIKFHSHSEHKESFYYDLFYIKGNLPDQYLQIYNDNKTIDSSDYHIDVYLFT

SEQ ID NO: 31872 - protein, 239 aa, Staphylococcus aureus; identical to SEQ ID NO: 30171
  strain TCH60

SEQ ID NO: 31873 - protein, 242 aa, Staphylococcus aureus; identical to SEQ ID NO: 30522
  strain TCH60

SEQ ID NO: 31874 - protein, 261 aa, Staphylococcus aureus; identical to SEQ ID NO: 30506
  strain TCH60

SEQ ID NO: 31875 - protein, 251 aa, Staphylococcus aureus; identical to SEQ ID NO: 30505
  strain TCH60

SEQ ID NO: 31876 - protein, 258 aa, Staphylococcus aureus; identical to SEQ ID NO: 30518
  strain TCH60

SEQ ID NO: 31877 - protein, 806 aa, Staphylococcus aureus
  strain TCH60
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVTNSNDAGVNFELTK

SEQ ID NO: 31878 - protein, 331 aa, Staphylococcus aureus; identical to SEQ ID NO: 31235
  strain TCH60

SEQ ID NO: 31879 - protein, 1149 aa, Staphylococcus aureus
  strain TCH60
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDAINPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31880 - protein, 1484 aa, Staphylococcus aureus
  strain TCH60
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31881 - protein, 880 aa, Staphylococcus aureus
  strain TCH60
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDVYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 31882 - protein, 1280 aa, Staphylococcus aureus
  strain TCH60
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNYTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKNFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATSVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKNKQREIKSLLK

SEQ ID NO: 31883 - protein, 890 aa, Staphylococcus aureus
  strain TCH60
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMSQPAQPKASANSDQASSQPAHETNSNDNTNDATNASSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTIEPLNVQTGQEDKVTATDTAENSSTATNPKDASDKADVIEPESDVVKDADSSVDKDVQNDVDHLSDMSDNTHLDKYDFKEMDTQIAKDTDKGVDNSLGMTSNVDTDKDSNKNEGKVIQLAHNTDKNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 31884 - protein, 291 aa, Staphylococcus aureus; identical to SEQ ID NO: 30390
  strain TCH60

SEQ ID NO: 31885 - protein, 167 aa, Staphylococcus aureus
  strain TCH60
MGEFEVKYLTGFILILLLEGIFTNSASAIEYSDLHHKSKLDSKRLYNAKVSFANPTDLENKKTNDRLLKHDLLFHDMFLNDAWKKDLKVEFENEALSKKFINKNIDVYAGSYSYECHGGETNKTQCSYGGVTLSDNNKYDDYKNIPCNLWIDGHQTEIELTAVKTKK

SEQ ID NO: 31886 - protein, 62 aa, Staphylococcus aureus
  strain TCH60
MYEQGGDIVKGYVKYHNDDEKNVEYDFYNLNGEYGHEVLKMYADNKTINSDKLHLDIYLFKS

SEQ ID NO: 31887 - protein, 221 aa, Staphylococcus aureus; identical to SEQ ID NO: 31036
  strain TCH60

SEQ ID NO: 31888 - protein, 504 aa, Staphylococcus aureus
  strain TCH60
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31889 - protein, 996 aa, Staphylococcus aureus; identical to SEQ ID NO: 30156
  strain TCH60

SEQ ID NO: 31890 - protein, 681 aa, Staphylococcus aureus
  strain TCH60
MMKSQNKYSIRKFSVGASSILIATLLFLSDGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 31891 - protein, 2169 aa, Staphylococcus aureus
  strain TCH60
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSDSTSTSDSVSGSLSIATSQSVSTSSSDSMSTSEMISDSMSTSGSLAASDSKSMSVSSSMSTSQSGSTSESLSDLISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSGSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSGSESESDSQSISTSASDSTSESTSTSLSDSTSTSNSTSESTSKAISTSASASESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSSSLNGSESVSESSSLSYSISMSDSTSTSDSDSLSGSISLSGSTSLSTSDSLSDSKSLSSSQSMSGSESTSTSVSDSQSSSTSNSQFDSMSISASESDSVSTSDSSSISRSNSTSTSLSTSDSMSGSVSVSTSTSLSDSISGSTSVSDSSSTSTSESLSDSMAQSQSTSTSASGSLSTSISTSMSMSASKSTSQSTSVSTSLSTSDSISDSTSISISGSQSAVESESTSDSTSISDSESLSTSDSDSTSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 31892 - protein, 933 aa, Staphylococcus aureus
  strain TCH60
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 31893 - protein, 312 aa, Staphylococcus aureus; identical to SEQ ID NO: 30391
  strain TCH60

SEQ ID NO: 31894 - protein, 325 aa, Staphylococcus aureus; identical to SEQ ID NO: 30484
  strain TCH60

SEQ ID NO: 31895 - protein, 233 aa, Staphylococcus aureus; identical to SEQ ID NO: 31039
  strain TCH60

SEQ ID NO: 31896 - protein, 1064 aa, Staphylococcus aureus
  strain TCH60
MHLKGDIIVKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 31897 - protein, 906 aa, Staphylococcus aureus
  strain TCH60
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 31898 - protein, 325 aa, Staphylococcus aureus; identical to SEQ ID NO: 30479
  strain TCH60

SEQ ID NO: 31899 - protein, 315 aa, Staphylococcus aureus; identical to SEQ ID NO: 31191
  strain TCH60

SEQ ID NO: 31900 - protein, 321 aa, Staphylococcus aureus
  strain TCH60
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 31901 - protein, 372 aa, Staphylococcus aureus
  strain TCH60
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVPSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKRA

SEQ ID NO: 31902 - protein, 251 aa, Staphylococcus aureus
  strain TCH60
MGNSRKGDYHMKKNITNKIVLSTALLLLGTTSTQPPKEPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNRYVKNPRHAEIEVILEKSH

SEQ ID NO: 31903 - protein, 225 aa, Staphylococcus aureus
  strain TCH60
MIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPVAKPSDKHYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 31904 - protein, 247 aa, Staphylococcus aureus
  strain TCH60
MITQKGEVRMRKCIMKKLILMTTLLLLGTTATQTSNSPLNVSTDAKAYHIGQDETNINELIKYYTQLPLTFSNRWLYQYDDGNIYVEFKRYSWSAHIRLWGAESWGNVNQLRDRYVDVFGLKDEDTSQLWWVYRDTFTGGVTPAASPSDKPYSLFVQYKDKLQTIIGAHKMYQGNKPILTLKEIDFRARETLIKNKILYHENRNKGKLKITGGGNDFTIDLSKRLHSDLANVYVKNPQKITVEVLID

SEQ ID NO: 31905 - protein, 322 aa, Staphylococcus aureus
  strain TCH60
MMKMKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKATKQQTNIDVIYERVRDDYQLHWTSTNWKGTNTKDKWTDRSSERYKIDWEKEEMTN

SEQ ID NO: 31906 - protein, 165 aa, Staphylococcus aureus; identical to SEQ ID NO: 31241
  strain TCH60

SEQ ID NO: 31907 - protein, 105 aa, Staphylococcus aureus; identical to SEQ ID NO: 31168
  strain TCH60

SEQ ID NO: 31908 - protein, 354 aa, Staphylococcus aureus
  strain TCH60
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKNENRQTTKVVSSEATKDQSQTKSARTVKTTQTAQDQNKVQTPVKDVATAKSESNNQAVSDNKSQQTNKVTKQNEVHKQGPSKDSKAKELPKTGLTSVDNFISTVAFATLALLGSLSLLLFKRKESK

SEQ ID NO: 31909 - protein, 648 aa, Staphylococcus aureus
  strain TCH60
MNKQQKEFKSFYSIRKSSLGVASVAISTLLLLMSNGEAKAAEETGVTNTEAQPKTEAVASPTTTTTEKAPEAKPVANAVSVSNKEVVAPTTETKEAKEVKAVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAMPSKPTTPPVEKESQKQDSQKDDNKQSPSVEKENDASSESGKDKMPVTKPAKAEVESSSTTPTKVVSTTQNVAKPTTASSETTKDVVQTSAGSSEAKDSAPLQKANIKNTNDGHTQSQNNKNTQENKAKSLPQTGEESNKDMTLPLMALIALSSIVAFVLPRKRKN

SEQ ID NO: 31910 - protein, 250 aa, Staphylococcus aureus
  strain TW20 / 0582
MGEFEVKYLTGFILILLLEGIFTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQTEIELTAVKTKKKIVTIQELEVQLRNYLNEKYKLYEQGGDIVKGYVKYYNDDEQNVEYDFYNLNGEYGREVLKMYADNKTINSDKLHLDIYLFKS

SEQ ID NO: 31911 - protein, 291 aa, Staphylococcus aureus
  strain TW20 / 0582
MKKIEAWLSKKGLKNKRTLIVVIAFVLFIIFLFLLLNSNSEDSGNITITENAELRTGPNAAYSVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 31912 - protein, 895 aa, Staphylococcus aureus
  strain TW20 / 0582
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIESSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKNDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 31913 - protein, 2186 aa, Staphylococcus aureus
  strain TW20 / 0582
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLTPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 31914 - protein, 203 aa, Staphylococcus aureus; identical to SEQ ID NO: 30770
  strain TW20 / 0582

SEQ ID NO: 31915 - protein, 226 aa, Staphylococcus aureus; identical to SEQ ID NO: 30769
  strain TW20 / 0582

SEQ ID NO: 31916 - protein, 231 aa, Staphylococcus aureus; identical to SEQ ID NO: 30768
  strain TW20 / 0582

SEQ ID NO: 31917 - protein, 352 aa, Staphylococcus aureus; identical to SEQ ID NO: 30767
  strain TW20 / 0582

SEQ ID NO: 31918 - protein, 308 aa, Staphylococcus aureus; identical to SEQ ID NO: 31787
  strain TW20 / 0582

SEQ ID NO: 31919 - protein, 234 aa, Staphylococcus aureus; identical to SEQ ID NO: 31052
  strain TW20 / 0582

SEQ ID NO: 31920 - protein, 231 aa, Staphylococcus aureus; identical to SEQ ID NO: 31761
  strain TW20 / 0582

SEQ ID NO: 31921 - protein, 231 aa, Staphylococcus aureus; identical to SEQ ID NO: 30560
  strain TW20 / 0582

SEQ ID NO: 31922 - protein, 232 aa, Staphylococcus aureus; identical to SEQ ID NO: 31054
  strain TW20 / 0582

SEQ ID NO: 31923 - protein, 232 aa, Staphylococcus aureus; identical to SEQ ID NO: 30765
  strain TW20 / 0582

SEQ ID NO: 31924 - protein, 227 aa, Staphylococcus aureus; identical to SEQ ID NO: 30585
  strain TW20 / 0582

SEQ ID NO: 31925 - protein, 225 aa, Staphylococcus aureus; identical to SEQ ID NO: 30763
  strain TW20 / 0582

SEQ ID NO: 31926 - protein, 331 aa, Staphylococcus aureus; identical to SEQ ID NO: 30732
  strain TW20 / 0582

SEQ ID NO: 31927 - protein, 327 aa, Staphylococcus aureus; identical to SEQ ID NO: 30538
  strain TW20 / 0582

SEQ ID NO: 31928 - protein, 311 aa, Staphylococcus aureus
  strain TW20 / 0582
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIAGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 31929 - protein, 257 aa, Staphylococcus aureus; identical to SEQ ID NO: 30259
  strain TW20 / 0582

SEQ ID NO: 31930 - protein, 923 aa, Staphylococcus aureus
  strain TW20 / 0582
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 31931 - protein, 1381 aa, Staphylococcus aureus
  strain TW20 / 0582
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYKFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 31932 - protein, 1137 aa, Staphylococcus aureus
  strain TW20 / 0582
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31933 - protein, 338 aa, Staphylococcus aureus; identical to SEQ ID NO: 30699
  strain TW20 / 0582

SEQ ID NO: 31934 - protein, 351 aa, Staphylococcus aureus; identical to SEQ ID NO: 30720
  strain TW20 / 0582

SEQ ID NO: 31935 - protein, 44 aa, Staphylococcus aureus; identical to SEQ ID NO: 30513
  strain TW20 / 0582

SEQ ID NO: 31936 - protein, 204 aa, Staphylococcus aureus
  strain TW20 / 0582
MKKSKVLATTTLAGALLFTGVGATHNAHAADYVNDSNVRDYAKNAIGSKYTEAGSVSIGGHGGGVTDKDNGVKDNGDYYTVIFSGEKDNGVGAAKVYKDGRIEAQTPRDANNVLTIDAPNNTQSTDNTQAATNNNTTATTDNNVSTQENNTQSTQSTQTNEAQTTTKALPETGGQSNSGLVTIIASVLLAAGSLLAFRRTSNSK

SEQ ID NO: 31937 - protein, 434 aa, Staphylococcus aureus [sequence omitted]

SEQ ID NO: 31938 - protein, 231 aa, Staphylococcus aureus; identical to SEQ ID NO: 31073
  strain TW20 / 0582

SEQ ID NO: 31939 - protein, 2478 aa, Staphylococcus aureus
  strain TW20 / 0582
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 31940 - protein, 927 aa, Staphylococcus aureus
  strain TW20 / 0582
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 31941 - protein, 242 aa, Staphylococcus aureus; identical to SEQ ID NO: 30396
  strain TW20 / 0582

SEQ ID NO: 31942 - protein, 256 aa, Staphylococcus aureus; identical to SEQ ID NO: 30531
  strain TW20 / 0582

SEQ ID NO: 31943 - protein, 807 aa, Staphylococcus aureus; identical to SEQ ID NO: 30716
  strain TW20 / 0582

SEQ ID NO: 31944 - protein, 141 aa, Staphylococcus aureus; identical to SEQ ID NO: 30715
  strain TW20 / 0582

SEQ ID NO: 31945 - protein, 645 aa, Staphylococcus aureus; identical to SEQ ID NO: 30747
  strain TW20 / 0582

SEQ ID NO: 31946 - protein, 350 aa, Staphylococcus aureus; identical to SEQ ID NO: 30602
  strain TW20 / 0582

SEQ ID NO: 31947 - protein, 321 aa, Staphylococcus aureus; identical to SEQ ID NO: 30959
  strain TW20 / 0582

SEQ ID NO: 31948 - protein, 315 aa, Staphylococcus aureus; identical to SEQ ID NO: 30440
  strain TW20 / 0582

SEQ ID NO: 31949 - protein, 325 aa, Staphylococcus aureus; identical to SEQ ID NO: 30407
  strain TW20 / 0582

SEQ ID NO: 31950 - protein, 109 aa, Staphylococcus aureus; identical to SEQ ID NO: 30744
  strain TW20 / 0582

SEQ ID NO: 31951 - protein, 165 aa, Staphylococcus aureus; identical to SEQ ID NO: 30742
  strain TW20 / 0582

SEQ ID NO: 31952 - protein, 238 aa, Staphylococcus aureus; identical to SEQ ID NO: 30740
  strain TW20 / 0582

SEQ ID NO: 31953 - protein, 241 aa, Staphylococcus aureus
  strain TW20 / 0582
MNNNITKKIILSTTLLLLGTASTQFPNTPINSSSEAKAHYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 31954 - protein, 241 aa, Staphylococcus aureus; identical to SEQ ID NO: 30738
  strain TW20 / 0582

SEQ ID NO: 31955 - protein, 917 aa, Staphylococcus aureus; identical to SEQ ID NO: 31037
  strain TW20 / 0582

SEQ ID NO: 31956 - protein, 995 aa, Staphylococcus aureus; identical to SEQ ID NO: 31038
  strain TW20 / 0582

SEQ ID NO: 31957 - protein, 233 aa, Staphylococcus aureus; identical to SEQ ID NO: 31039
  strain TW20 / 0582

SEQ ID NO: 31958 - protein, 939 aa, Staphylococcus aureus
  strain TW20 / 0582
MKWSNIFEKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 31959 - protein, 1759 aa, Staphylococcus aureus; identical to SEQ ID NO: 31045
  strain TW20 / 0582

SEQ ID NO: 31960 - protein, 681 aa, Staphylococcus aureus; identical to SEQ ID NO: 31046
  strain TW20 / 0582

SEQ ID NO: 31961 - protein, 809 aa, Staphylococcus aureus
  strain TW20 / 0582
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 31962 - protein, 190 aa, Staphylococcus aureus; identical to SEQ ID NO: 30534
  strain TW20 / 0582

SEQ ID NO: 31963 - protein, 426 aa, Staphylococcus aureus
  strain TW20 / 0582
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31964 - protein, 221 aa, Staphylococcus aureus; identical to SEQ ID NO: 31036
  strain TW20 / 0582

SEQ ID NO: 31965 - protein, 436 aa, Staphylococcus aureus [sequence omitted]

SEQ ID NO: 31966 - protein, 321 aa, Staphylococcus aureus; identical to SEQ ID NO: 30959
  strain USA300 / TCH1516

SEQ ID NO: 31967 - protein, 315 aa, Staphylococcus aureus; identical to SEQ ID NO: 30440
  strain USA300 / TCH1516

SEQ ID NO: 31968 - protein, 325 aa, Staphylococcus aureus; identical to SEQ ID NO: 30407
  strain USA300 / TCH1516

SEQ ID NO: 31969 - protein, 940 aa, Staphylococcus aureus; identical to SEQ ID NO: 30465
  strain USA300 / TCH1516

SEQ ID NO: 31970 - protein, 1018 aa, Staphylococcus aureus; identical to SEQ ID NO: 30707
  strain USA300 / TCH1516

SEQ ID NO: 31971 - protein, 504 aa, Staphylococcus aureus
  strain USA300 / TCH1516
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31972 - protein, 241 aa, Staphylococcus aureus; identical to SEQ ID NO: 30776
  strain USA300 / TCH1516

SEQ ID NO: 31973 - protein, 690 aa, Staphylococcus aureus
  strain USA300 / TCH1516
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRMQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 31974 - protein, 203 aa, Staphylococcus aureus; identical to SEQ ID NO: 30770
  strain USA300 / TCH1516

SEQ ID NO: 31975 - protein, 947 aa, Staphylococcus aureus
  strain USA300 / TCH1516
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 31976 - protein, 1381 aa, Staphylococcus aureus; identical to SEQ ID NO: 30760
  strain USA300 / TCH1516

SEQ ID NO: 31977 - protein, 1154 aa, Staphylococcus aureus
  strain USA300 / TCH1516
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 31978 - protein, 226 aa, Staphylococcus aureus; identical to SEQ ID NO: 30769
  strain USA300 / TCH1516

SEQ ID NO: 31979 - protein, 231 aa, Staphylococcus aureus; identical to SEQ ID NO: 30768
  strain USA300 / TCH1516

SEQ ID NO: 31980 - protein, 352 aa, Staphylococcus aureus; identical to SEQ ID NO: 30767
  strain USA300 / TCH1516

SEQ ID NO: 31981 - protein, 308 aa, Staphylococcus aureus; identical to SEQ ID NO: 31787
  strain USA300 / TCH1516

SEQ ID NO: 31982 - protein, 239 aa, Staphylococcus aureus
  strain USA300 / TCH1516
MEHTTMKMTAIAKASLALGILATGTITSLHQTVNASEHKAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 31983 - protein, 231 aa, Staphylococcus aureus; identical to SEQ ID NO: 31761
  strain USA300 / TCH1516

SEQ ID NO: 31984 - protein, 231 aa, Staphylococcus aureus; identical to SEQ ID NO: 30560
  strain USA300 / TCH1516

SEQ ID NO: 31985 - protein, 232 aa, Staphylococcus aureus; identical to SEQ ID NO: 31054
  strain USA300 / TCH1516

SEQ ID NO: 31986 - protein, 232 aa, Staphylococcus aureus; identical to SEQ ID NO: 30765
  strain USA300 / TCH1516

SEQ ID NO: 31987 - protein, 227 aa, Staphylococcus aureus; identical to SEQ ID NO: 30585
  strain USA300 / TCH1516

SEQ ID NO: 31988 - protein, 225 aa, Staphylococcus aureus; identical to SEQ ID NO: 30763
  strain USA300 / TCH1516

SEQ ID NO: 31989 - protein, 434 aa, Staphylococcus aureus [sequence omitted]

SEQ ID NO: 31990 - protein, 933 aa, Staphylococcus aureus; identical to SEQ ID NO: 30755
  strain USA300 / TCH1516

SEQ ID NO: 31991 - protein, 242 aa, Staphylococcus aureus
  strain USA300 / TCH1516
MKKLIVIILINIITLSVSNSASAQGDIGIDNLRNFYTKKDFVDLKDVKDNDTPIANQLQFSNVSYDLISESKDFNKFSNFKGKKLDVFGISYNGQCNNKYIYGGVTATNEYLDKPRNIPINIWINGNHKTISTNKVSTNKKFVTAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 31992 - protein, 242 aa, Staphylococcus aureus
  strain USA300 / TCH1516
MNKIFRVLTVSLFFFTFLIKNNLAYADVGVINLRNFYTNYQPETLQGVSSGNFSTSHQLEYIDGKYTLYSQFHNEYEAKRLKDHKVDIFGISYSGLCNTKYMYGGITLANQNLDKPRNIPINLWVNGKQNTISTDEVSTQKKEVTAQEIDIKLRKYLQNEYNIYGFNKTKKGQEYGYQSKFNSGFNKGKITFHLNNETSFTYDLFYTGTGQAESFLKIYNDNKTIDAENFHLDVEISYEKTE

SEQ ID NO: 31993 - protein, 350 aa, Staphylococcus aureus; identical to SEQ ID NO: 30602
  strain USA300 / TCH1516

SEQ ID NO: 31994 - protein, 227 aa, Staphylococcus aureus; identical to SEQ ID NO: 30927
  strain USA300 / TCH1516

SEQ ID NO: 31995 - protein, 109 aa, Staphylococcus aureus; identical to SEQ ID NO: 30744
  strain USA300 / TCH1516

SEQ ID NO: 31996 - protein, 165 aa, Staphylococcus aureus; identical to SEQ ID NO: 30742
  strain USA300 / TCH1516

SEQ ID NO: 31997 - protein, 319 aa, Staphylococcus aureus; identical to SEQ ID NO: 30741
  strain USA300 / TCH1516

SEQ ID NO: 31998 - protein, 238 aa, Staphylococcus aureus; identical to SEQ ID NO: 30740
  strain USA300 / TCH1516

SEQ ID NO: 31999 - protein, 241 aa, Staphylococcus aureus; identical to SEQ ID NO: 30739
  strain USA300 / TCH1516

SEQ ID NO: 32000 - protein, 241 aa, Staphylococcus aureus; identical to SEQ ID NO: 30738
  strain USA300 / TCH1516

SEQ ID NO: 32001 - protein, 325 aa, Staphylococcus aureus; identical to SEQ ID NO: 30484
  strain USA300 / TCH1516

SEQ ID NO: 32002 - protein, 312 aa, Staphylococcus aureus; identical to SEQ ID NO: 30196
  strain USA300 / TCH1516

SEQ ID NO: 32003 - protein, 291 aa, Staphylococcus aureus; identical to SEQ ID NO: 31911
  strain USA300 / TCH1516

SEQ ID NO: 32004 - protein, 895 aa, Staphylococcus aureus; identical to SEQ ID NO: 30734
  strain USA300 / TCH1516

SEQ ID NO: 32005 - protein, 809 aa, Staphylococcus aureus
  strain USA300 / TCH1516
MSMTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 32006 - protein, 141 aa, Staphylococcus aureus; identical to SEQ ID NO: 30715
  strain USA300 / TCH1516

SEQ ID NO: 32007 - protein, 233 aa, Staphylococcus aureus; identical to SEQ ID NO: 30428
  strain USA300 / TCH1516

SEQ ID NO: 32008 - protein, 383 aa, Staphylococcus aureus; identical to SEQ ID NO: 31779
  strain USA300 / TCH1516

SEQ ID NO: 32009 - protein, 234 aa, Staphylococcus aureus; identical to SEQ ID NO: 30736
  strain USA300 / TCH1516

SEQ ID NO: 32010 - protein, 2186 aa, Staphylococcus aureus; identical to SEQ ID NO: 31059
  strain USA300 / TCH1516

SEQ ID NO: 32011 - protein, 331 aa, Staphylococcus aureus; identical to SEQ ID NO: 30732
  strain USA300 / TCH1516

SEQ ID NO: 32012 - protein, 239 aa, Staphylococcus aureus; identical to SEQ ID NO: 30731
  strain USA300 / TCH1516

SEQ ID NO: 32013 - protein, 238 aa, Staphylococcus aureus; identical to SEQ ID NO: 30730
  strain USA300 / TCH1516

SEQ ID NO: 32014 - protein, 239 aa, Staphylococcus aureus; identical to SEQ ID NO: 31390
  strain USA300 / TCH1516

SEQ ID NO: 32015 - protein, 239 aa, Staphylococcus aureus; identical to SEQ ID NO: 30728
  strain USA300 / TCH1516

SEQ ID NO: 32016 - protein, 240 aa, Staphylococcus aureus; identical to SEQ ID NO: 30727
  strain USA300 / TCH1516

SEQ ID NO: 32017 - protein, 235 aa, Staphylococcus aureus; identical to SEQ ID NO: 31727
  strain USA300 / TCH1516

SEQ ID NO: 32018 - protein, 327 aa, Staphylococcus aureus; identical to SEQ ID NO: 30538
  strain USA300 / TCH1516

SEQ ID NO: 32019 - protein, 311 aa, Staphylococcus aureus; identical to SEQ ID NO: 30617
  strain USA300 / TCH1516

SEQ ID NO: 32020 - protein, 338 aa, Staphylococcus aureus; identical to SEQ ID NO: 30699
  strain USA300 / TCH1516

SEQ ID NO: 32021 - protein, 351 aa, Staphylococcus aureus; identical to SEQ ID NO: 30720
  strain USA300 / TCH1516

SEQ ID NO: 32022 - protein, 44 aa, Staphylococcus aureus; identical to SEQ ID NO: 30513
  strain USA300 / TCH1516

SEQ ID NO: 32023 - protein, 899 aa, Staphylococcus aureus
  strain USA300 / TCH1516
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32024 - protein, 2271 aa, Staphylococcus aureus
  strain USA300 / TCH1516
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSAFTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 32025 - protein, 681 aa, Staphylococcus aureus
  strain USA300 / TCH1516
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 32026 - protein, 645 aa, Staphylococcus aureus; identical to SEQ ID NO: 30747
  strain USA300 / TCH1516

SEQ ID NO: 32027 - protein, 680 aa, Staphylococcus aureus; identical to SEQ ID NO: 30700
  strain USA300

SEQ ID NO: 32028 - protein, 2271 aa, Staphylococcus aureus; identical to SEQ ID NO: 32024
  strain USA300

SEQ ID NO: 32029 - protein, 175 aa, Staphylococcus aureus; identical to SEQ ID NO: 30554
  strain USA300

SEQ ID NO: 32030 - protein, 899 aa, Staphylococcus aureus; identical to SEQ ID NO: 32023
  strain USA300

SEQ ID NO: 32031 - protein, 233 aa, Staphylococcus aureus; identical to SEQ ID NO: 30428
  strain USA300

SEQ ID NO: 32032 - protein, 1018 aa, Staphylococcus aureus; identical to SEQ ID NO: 30707
  strain USA300

SEQ ID NO: 32033 - protein, 940 aa, Staphylococcus aureus; identical to SEQ ID NO: 30465
  strain USA300

SEQ ID NO: 32034 - protein, 444 aa, Staphylococcus aureus
  strain USA300
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLIRI

SEQ ID NO: 32035 - protein, 196 aa, Staphylococcus aureus; identical to SEQ ID NO: 30587
  strain USA300

SEQ ID NO: 32036 - protein, 325 aa, Staphylococcus aureus; identical to SEQ ID NO: 30407
  strain USA300

SEQ ID NO: 32037 - protein, 315 aa, Staphylococcus aureus; identical to SEQ ID NO: 30440
  strain USA300

SEQ ID NO: 32038 - protein, 309 aa, Staphylococcus aureus; identical to SEQ ID NO: 30406
  strain USA300

SEQ ID NO: 32039 - protein, 436 aa, Staphylococcus aureus [sequence omitted]

SEQ ID NO: 32040 - protein, 141 aa, Staphylococcus aureus; identical to SEQ ID NO: 30715
  strain USA300

SEQ ID NO: 32041 - protein, 807 aa, Staphylococcus aureus; identical to SEQ ID NO: 30716
  strain USA300

SEQ ID NO: 32042 - protein, 1102 aa, Staphylococcus aureus
  strain USA300
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAK

SEQ ID NO: 32043 - protein, 231 aa, Staphylococcus aureus; identical to SEQ ID NO: 31073
  strain USA300

SEQ ID NO: 32044 - protein, 44 aa, Staphylococcus aureus; identical to SEQ ID NO: 30513
  strain USA300

SEQ ID NO: 32045 - protein, 351 aa, Staphylococcus aureus; identical to SEQ ID NO: 30720
  strain USA300

SEQ ID NO: 32046 - protein, 338 aa, Staphylococcus aureus; identical to SEQ ID NO: 30699
  strain USA300

SEQ ID NO: 32047 - protein, 274 aa, Staphylococcus aureus; identical to SEQ ID NO: 30872
  strain USA300

SEQ ID NO: 32048 - protein, 149 aa, Staphylococcus aureus [sequence omitted]

SEQ ID NO: 32049 - protein, 116 aa, Staphylococcus aureus; identical to SEQ ID NO: 31223
  strain USA300

SEQ ID NO: 32050 - protein, 311 aa, Staphylococcus aureus; identical to SEQ ID NO: 30617
  strain USA300

SEQ ID NO: 32051 - protein, 327 aa, Staphylococcus aureus; identical to SEQ ID NO: 30538
  strain USA300

SEQ ID NO: 32052 - protein, 235 aa, Staphylococcus aureus; identical to SEQ ID NO: 31727
  strain USA300

SEQ ID NO: 32053 - protein, 240 aa, Staphylococcus aureus; identical to SEQ ID NO: 30727
  strain USA300

SEQ ID NO: 32054 - protein, 239 aa, Staphylococcus aureus; identical to SEQ ID NO: 30728
  strain USA300

SEQ ID NO: 32055 - protein, 239 aa, Staphylococcus aureus; identical to SEQ ID NO: 31390
  strain USA300

SEQ ID NO: 32056 - protein, 238 aa, Staphylococcus aureus; identical to SEQ ID NO: 30730
  strain USA300

SEQ ID NO: 32057 - protein, 239 aa, Staphylococcus aureus
  strain USA300
MNKNIIIKSIGALTILTSITGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 32058 - protein, 331 aa, Staphylococcus aureus; identical to SEQ ID NO: 30732
  strain USA300

SEQ ID NO: 32059 - protein, 2186 aa, Staphylococcus aureus; identical to SEQ ID NO: 31059
  strain USA300

SEQ ID NO: 32060 - protein, 895 aa, Staphylococcus aureus; identical to SEQ ID NO: 30734
  strain USA300

SEQ ID NO: 32061 - protein, 291 aa, Staphylococcus aureus; identical to SEQ ID NO: 30390
  strain USA300

SEQ ID NO: 32062 - protein, 234 aa, Staphylococcus aureus; identical to SEQ ID NO: 30736
  strain USA300

SEQ ID NO: 32063 - protein, 312 aa, Staphylococcus aureus; identical to SEQ ID NO: 30196
  strain USA300

SEQ ID NO: 32064 - protein, 325 aa, Staphylococcus aureus; identical to SEQ ID NO: 30484
  strain USA300

SEQ ID NO: 32065 - protein, 383 aa, Staphylococcus aureus; identical to SEQ ID NO: 31779
  strain USA300

SEQ ID NO: 32066 - protein, 241 aa, Staphylococcus aureus; identical to SEQ ID NO: 30738
  strain USA300

SEQ ID NO: 32067 - protein, 241 aa, Staphylococcus aureus; identical to SEQ ID NO: 30739
  strain USA300

SEQ ID NO: 32068 - protein, 238 aa, Staphylococcus aureus; identical to SEQ ID NO: 30740
  strain USA300

SEQ ID NO: 32069 - protein, 319 aa, Staphylococcus aureus; identical to SEQ ID NO: 30741
  strain USA300

SEQ ID NO: 32070 - protein, 165 aa, Staphylococcus aureus; identical to SEQ ID NO: 30742
  strain USA300

SEQ ID NO: 32071 - protein, 133 aa, Staphylococcus aureus; identical to SEQ ID NO: 30743
  strain USA300

SEQ ID NO: 32072 - protein, 109 aa, Staphylococcus aureus; identical to SEQ ID NO: 30744
  strain USA300

SEQ ID NO: 32073 - protein, 227 aa, Staphylococcus aureus; identical to SEQ ID NO: 30927
  strain USA300

SEQ ID NO: 32074 - protein, 350 aa, Staphylococcus aureus; identical to SEQ ID NO: 30602
  strain USA300

SEQ ID NO: 32075 - protein, 645 aa, Staphylococcus aureus; identical to SEQ ID NO: 30747
  strain USA300

SEQ ID NO: 32076 - protein, 242 aa, Staphylococcus aureus; identical to SEQ ID NO: 31992
  strain USA300

SEQ ID NO: 32077 - protein, 242 aa, Staphylococcus aureus; identical to SEQ ID NO: 31991
  strain USA300

SEQ ID NO: 32078 - protein, 933 aa, Staphylococcus aureus; identical to SEQ ID NO: 30755
  strain USA300

SEQ ID NO: 32079 - protein, 434 aa, Staphylococcus aureus [sequence omitted]

SEQ ID NO: 32080 - protein, 646 aa, Staphylococcus aureus; identical to SEQ ID NO: 30757
  strain USA300

SEQ ID NO: 32081 - protein, 1154 aa, Staphylococcus aureus; identical to SEQ ID NO: 31977
  strain USA300

SEQ ID NO: 32082 - protein, 1381 aa, Staphylococcus aureus; identical to SEQ ID NO: 30760
  strain USA300

SEQ ID NO: 32083 - protein, 947 aa, Staphylococcus aureus; identical to SEQ ID NO: 31975
  strain USA300

SEQ ID NO: 32084 - protein, 334 aa, Staphylococcus aureus; identical to SEQ ID NO: 30414
  strain USA300

SEQ ID NO: 32085 - protein, 225 aa, Staphylococcus aureus; identical to SEQ ID NO: 30763
  strain USA300

SEQ ID NO: 32086 - protein, 227 aa, Staphylococcus aureus; identical to SEQ ID NO: 30585
  strain USA300

SEQ ID NO: 32087 - protein, 232 aa, Staphylococcus aureus; identical to SEQ ID NO: 30765
  strain USA300

SEQ ID NO: 32088 - protein, 232 aa, Staphylococcus aureus; identical to SEQ ID NO: 31054
  strain USA300

SEQ ID NO: 32089 - protein, 231 aa, Staphylococcus aureus; identical to SEQ ID NO: 30560
  strain USA300

SEQ ID NO: 32090 - protein, 231 aa, Staphylococcus aureus; identical to SEQ ID NO: 31761
  strain USA300

SEQ ID NO: 32091 - protein, 234 aa, Staphylococcus aureus; identical to SEQ ID NO: 31052
  strain USA300

SEQ ID NO: 32092 - protein, 308 aa, Staphylococcus aureus; identical to SEQ ID NO: 31787
  strain USA300

SEQ ID NO: 32093 - protein, 352 aa, Staphylococcus aureus; identical to SEQ ID NO: 30767
  strain USA300

SEQ ID NO: 32094 - protein, 231 aa, Staphylococcus aureus; identical to SEQ ID NO: 30768
  strain USA300

SEQ ID NO: 32095 - protein, 226 aa, Staphylococcus aureus; identical to SEQ ID NO: 30769
  strain USA300

SEQ ID NO: 32096 - protein, 203 aa, Staphylococcus aureus; identical to SEQ ID NO: 30770
  strain USA300

SEQ ID NO: 32097 - protein, 690 aa, Staphylococcus aureus; identical to SEQ ID NO: 31973
  strain USA300

SEQ ID NO: 32098 - protein, 241 aa, Staphylococcus aureus; identical to SEQ ID NO: 30776
  strain USA300

SEQ ID NO: 32099 - protein, 508 aa, Staphylococcus aureus; identical to SEQ ID NO: 30777
  strain USA300

SEQ ID NO: 32100 - protein, 241 aa, Staphylococcus aureus 08BA02176; identical to SEQ ID NO: 31149

SEQ ID NO: 32101 - protein, 343 aa, Staphylococcus aureus 08BA02176; identical to SEQ ID NO: 31154

SEQ ID NO: 32102 - protein, 226 aa, Staphylococcus aureus 08BA02176; identical to SEQ ID NO: 31160

SEQ ID NO: 32103 - protein, 231 aa, Staphylococcus aureus 08BA02176; identical to SEQ ID NO: 31157

SEQ ID NO: 32104 - protein, 1390 aa, Staphylococcus aureus 08BA02176
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVASEKNNNSQPSENGKLQTSDVKKTEANNTTLDDQVTTTVNSQQLNTDNTTSNATMSSAPINVSKDDLKINNEEVRNVGEKSDNADNANGSDVIMPKSTAPKRLNTRMRMAAIQSTSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPANIGQINQNVTNIKIYRVPEGYTLNKGYDVNANDLVDVTDEFKNKMTYGTNQSVNIDFGDITSAYVVMVNTKFQYTNSESPTLVQMATLSSTGNKTVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDEKGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHQNKAKALPETGSENNGSNNATLFGGLFAVLGSLLLFGRRKKQNK

SEQ ID NO: 32105 - protein, 642 aa, Staphylococcus aureus 08BA02176
MNKQQKEFKSFYSIRKSSLGVASVAISTLLLLMSNGEAKAAEETGGTNTEAQPKTEAVASPTTTTTEKAPEAKPVANAVSVANKEVVAPTTETKEVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSASVEKENDASSESAKDKTPATKPAKAEVESSSTTPTKVVSTTQNVAKPTTASSETTKDVVQTSAGSSEAKDSAPLQKANIKNTNDGDTQSQNNKNTQENKAKSLPQTGEESNKDMTLPLMALLALSSIVAFVLPRKRKN

SEQ ID NO: 32106 - protein, 319 aa, Staphylococcus aureus 08BA02176; identical to SEQ ID NO: 31170

SEQ ID NO: 32107 - protein, 351 aa, Staphylococcus aureus 08BA02176; identical to SEQ ID NO: 31184

SEQ ID NO: 32108 - protein, 2459 aa, Staphylococcus aureus 08BA02176
MNLFRQQKFSIRKFNVGIFSALIATVTFISINPTTASAAEQNQPAQNQPAQPADASAQPNANAGAQANPTAQPAAPANQGQPAAQPANQGGQANPAGGAAQPAAGTTQPAGQGNQADPNNAAQAQPGNQAAPANQAGQGNNQATPNNNATPANQTQPANAPAAAQPAAPVAANAQTQDPNASNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEIFKIENITDSTQTKMDAYKEVKQAATARKAQNATVSNATDEEVAEADAAVDAAQTEGLHDIQVVKSQQEVADTKAKVLDKINAIQTQARVKPAADTEVENAYNTRKQEIQNSNASTTEEKQAAYTELDTKKQEARTNLDTANSNSEVATAKDNSIAAINQVQAATTKKSDAKAEIAQKASERKTAIEAMNDSTTEEQQAAKDKVDQAVVNANADIDNAAANNDVDNAKTTNEATIAAITPDANVKPQAKQAIADKVQAQETAIDANNGATTEEKTAAKQQVQTEKTTADAAIDGAHSNAEVEAAKNAEIAKIEAIQPATTTKDDAKQAIATKANERKAAIAQTQEITAEEIAAANANVDNAVTEANNHIETANSQNEVDQAKTTGEASIDQVTPTVNKKATARNEITTILNNKLQAIQATPDATDEEKQAAETEANTENAKANQAITAATTNAEVDEAKTNAEAAINAVTPKVMKKQAAKDEIDQLQAAQTAVINNDQNATNEEKEAAIQQLATAVTDAKNNITAATDNNGVDTAKDAGKNSIQSTQPATAVKSNAKNEVDQAVTTQNQAIDNTTGATTEEKNAAKDLVSKAKEKAYQDILNAQTTNDVTQIKDQAVADIQGITADTTIKDVAKDELATKAKEQKALIAQTADATTEEKEQANQQVDAQLTQGNQNIENAQSIDDVNTAKDNAIQAIDPIQASTDVKTNARAELLNEMQNKITEILNDNTTTNEEKGKDIEPVRAAYEEGLNNINAATTTGDVTTAKDTAVQKVQQLHANPVKKPAGKTELDQAAADKKTQIEQTPNASQQEINDAKQEVDAALNQAKTNIDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNILADTNATQDEKQQAIKQVDQNVQTALESINNGVDNSDVDDALTQGKAAIDAIQVDATVKPKANQAIDDKAQETKESIDQSDQLTAEEKTAALATIKQITDQAKQGITDATTTAEVEKAKAQGLEAFDNIQIDSTEKQKAIEELETSLDQIEAGVNVNVDATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNAEVDELQNVTIPAIEAIVPQKDPNANDTNSGSDNNDATANSNANATPENTGQPNVTESTDNANADTSSTTTNNQNDAATGGTTATSTNNSSVDASTDNSATGNGTTDKPATETDNATPAEGTRNNNGTATATNENAPTGSTATAPTTNASTGAASSADSKDNASVNDSKQNAEVNNSAESQSTNGKVAQPKSENKAKAEKDGRDSTNQSMVESTTETLPSADITGPKVPSNTEKDKEESTTNQTDAGQLKSETNVASNEADKSEGNVDTDVSNKPSTSASSEAKEKMTSINVSQKDDTATADTNDTQTSVGPVANNKATQNDGTNASPATVSNGSNSANQDMLNVTNTEENKANAKSAQQGKVNKLKQQAKTLPDTGMSHNDDLPYAELALGAGMAFLIRRFTKKDQQTEE

SEQ ID NO: 32109 - protein, 532 aa, Staphylococcus aureus 08BA02176
MDKTKNYVIKYEGDYNSSASDLNFQTKLSGYHNYYYSYYPVQLTWNNGVAFYSNNAQGDGKDKPKEPIIEHSTPIELEFKSEPPMEKHELTGTVEESDDSKPIDFEYHTAVEGAEGHAEGTIETEEDSIHVDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPGEPTPPTPEVPSEPETPVPPTPEVPSEPGKPVPPAKEEPKKPSKPVEQGKVVTPVIEINEKVKAVAPTKQKQSKKSELPETGGEESTNKGILFGGLFSILGLALLRRNKKNHKA

SEQ ID NO: 32110 - protein, 233 aa, Staphylococcus aureus 08BA02176; identical to SEQ ID NO: 31195

SEQ ID NO: 32111 - protein, 2279 aa, Staphylococcus aureus 08BA02176; identical to SEQ ID NO: 31197

SEQ ID NO: 32112 - protein, 233 aa, Staphylococcus aureus 08BA02176; identical to SEQ ID NO: 31153

SEQ ID NO: 32113 - protein, 870 aa, Staphylococcus aureus 08BA02176
MNNKKTATNRKGMIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQSTKQNNDATANKDNLEAQNISTQAKDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLKEVTNQFNITYSNDNKTATVDLLNGQTSSNKQYIIQQVAYPDNTSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKMQKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSDSDSDAGKHSHSDKPMTATQNQTITIMQKHYQKQVVKITAQITQRYLVDYSRH

SEQ ID NO: 32114 - protein, 434 aa, Staphylococcus aureus 08BA02176 [sequence omitted]

SEQ ID NO: 32115 - protein, 241 aa, Staphylococcus aureus 08BA02176; identical to SEQ ID NO: 31173

SEQ ID NO: 32116 - protein, 226 aa, Staphylococcus aureus 08BA02176; identical to SEQ ID NO: 31152

SEQ ID NO: 32117 - protein, 234 aa, Staphylococcus aureus 08BA02176; identical to SEQ ID NO: 31156

SEQ ID NO: 32118 - protein, 807 aa, Staphylococcus aureus 08BA02176; identical to SEQ ID NO: 31180

SEQ ID NO: 32119 - protein, 338 aa, Staphylococcus aureus 08BA02176; identical to SEQ ID NO: 31183

SEQ ID NO: 32120 - protein, 309 aa, Staphylococcus aureus 08BA02176
MIKNKILTATLAVGLIAPLANPFTEISKAENKIEDIGQGAEIIKRTQDITSKRLAITQNIQFDFVKDKKYNKDALVVKMQGFISSRTTYSDLKKYPYIKRMIWLFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 32121 - protein, 105 aa, Staphylococcus aureus 08BA02176; identical to SEQ ID NO: 31168

SEQ ID NO: 32122 - protein, 241 aa, Staphylococcus aureus 08BA02176; identical to SEQ ID NO: 31172

SEQ ID NO: 32123 - protein, 291 aa, Staphylococcus aureus 08BA02176; identical to SEQ ID NO: 30390

SEQ ID NO: 32124 - protein, 895 aa, Staphylococcus aureus 08BA02176
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVASNDQSSSDASNQTNTNTSNQNTSTTNNASDQPQATTNMSQPAKPVSSANADQASSQPAHETNSNGNTNDKTNASSNQSNGNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYVSDKAIYNAIVKVVVANIGYEGQYHVRIVNQDIKTKDDDTSQNNTSEPLNVQTGQENKVSATDTAENSSTATNPKDASDKADVIEPESDVVKVTDSNIDKDAHHDVDHLSDMSDNTHLDKYDLKEMDTQIAKDTDKGVDKDADNSVGMSSNVDTEKDINKNEGKVIQLAHNTDKNNHTGKAAKLDGVRQNYNNIDKVTDKKTTEHPSNDIHKTVDKTVKTKEKSGTPSKENKLSQSKMLPKTGETTSSQTWWGLYVLLGMLALFIPKFRKEPK

SEQ ID NO: 32125 - protein, 330 aa, Staphylococcus aureus 08BA02176; identical to SEQ ID NO: 31182

SEQ ID NO: 32126 - protein, 93 aa, Staphylococcus aureus 08BA02176
MYTPKRNITLNKEVVTLKELDHIIRFAHISYGLYMGEHLPKGNIVINTKNGGKYTLESHKELQKDRENVKINTADIKNVTFKLVKSVNDIEQV

SEQ ID NO: 32127 - protein, 512 aa, Staphylococcus aureus 08BA02176
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDNKKPGKEDGNKPGKEDGNKPGKEDGNGIHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32128 - protein, 227 aa, Staphylococcus aureus 08BA02176; identical to SEQ ID NO: 31159

SEQ ID NO: 32129 - protein, 1017 aa, Staphylococcus aureus 08BA02176
MKNNLRYGIRKHKLGAASVFLGTMIVVGMGQDKEAAASEQKTTTVEENGNSATENKTSETQTTATNVNHIEETQSYNATVTEQPSNATQVTTEEAPKAVQAPQTAQPANVETVKEEVVKEEAKPQVKETTQSQDNSGDQRQVDLTPKKATQNQAAETQVEVAQPRTVSESKPRVTRSADVVEAKEASDASEIKGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVIANLNLNLFIDPRIVKNNGEETLTSKLNGKNTEKKIEVEYKDGVGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKADGNGQNGVKVESNNLIFDEVTGTGVITGQYDKNLVTTVEEETDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPGEPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 32130 - protein, 317 aa, Staphylococcus aureus 08BA02176; identical to SEQ ID NO: 31155

SEQ ID NO: 32131 - protein, 232 aa, Staphylococcus aureus 08BA02176; identical to SEQ ID NO: 31158

SEQ ID NO: 32132 - protein, 1145 aa, Staphylococcus aureus 08BA02176
MINRDNKKAITKKGMISNRLNKFSIRKYTVGTASILVGTTLIFGLGNQEAKAAENTSTENAKQDEASASDNEEVVSETENNSTTENTSTNPIKKETNTDSQPETKEESTTSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRLNAKMRFAVAQPAAVASNNVNDLIKVTKQTIKVGDGKDDVVAAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQNIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDDELDIAQGASMRTTDKNNYYNYAGYSNFIVTSTDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKIIGTTTTDASGKYKFTDLDNGNYTVEFETPAGYTPTLKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTGKHIPVKPMSATKDHDNKAKALPETGSENNGSNNATLFGGLFAALGSLLLFGRRKKQNK

SEQ ID NO: 32133 - protein, 70 aa, Staphylococcus aureus 08BA02176; identical to SEQ ID NO: 31174

SEQ ID NO: 32134 - protein, 943 aa, Staphylococcus aureus 08BA02176
MNMKKQEKHAIRKKSIGVASVLVGTLIGFGLLSSKEADASENSMTQTENTRNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDTSTEVTPSNNESAPQSTDASNKDVVNQTVNTSASRMRAFSLAAADAPAVGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVDTKNDVKATLTVPAYIDPENVTKTGNVTLTTGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSASDSDSASDSDSTSDSDSTSDSDSTSDSDSTSDSDSASDSDSASDSDSTSDSDSTSDSDSVSDSDSASDSDSDSDSDSDSDSDSDSDSDSDSDSDSDSDSDSDSDSDSDSDSDSDSDSDSDSDSDSDSDSDSESDSDSDSDSESESDSDSDSDSDSDSDSDSDSDSDSDSDSDSDSDSDSDSDSDSDSASDSDSDSDSDSDSDSDSDSDSDNDSDSDSDSDSASDSDSGSDSDSSSDSDSDSASDSDSDSDSTSDTGSDNDSDSESDSNSDSESGSNNNVVPPNSPKNGTNASNKNEAKDSKEPLPDTGSEDEANTSLIWGLLASLGSLLLFRRKKENKDKK

SEQ ID NO: 32135 - protein, 354 aa, Staphylococcus aureus 08BA02176; identical to SEQ ID NO: 31167

SEQ ID NO: 32136 - protein, 238 aa, Staphylococcus aureus 08BA02176; identical to SEQ ID NO: 31171

SEQ ID NO: 32137 - protein, 234 aa, Staphylococcus aureus 08BA02176
MLEGIFTNSASAIEYSDLHHKSKLDSKRLYNAKVSFANPTDLENKKTNDRLLKHDLLFHDMFVNDDWKKDFKVEFENEALSKKFINKDIDIFAGNYGYGCHGGEANKTQCSYGGVTFSDNNKYDDYKNIPCNLWIDGHQTEIELTAVKTKKKIVTIQELDVQLRNYLNEKYKLYEQGGDIVKGYVKYHNDDEKNVEYDFYNLNGEYGHEVLKMYADNKTINSDKLHLDIYLFKS

SEQ ID NO: 32138 - protein, 231 aa, Staphylococcus aureus 08BA02176; identical to SEQ ID NO: 30654

SEQ ID NO: 32139 - protein, 331 aa, Staphylococcus aureus 08BA02176; identical to SEQ ID NO: 31179

SEQ ID NO: 32140 - protein, 315 aa, Staphylococcus aureus 08BA02176; identical to SEQ ID NO: 31191

SEQ ID NO: 32141 - protein, 371 aa, Staphylococcus aureus 08BA02176
MKSNLRYGIRKHKLGAASVFLGTMIVVGMGQEKEAAASEQNNTTVEESGNSATESKASETQTTTNNVNTIDETQSYSATSTEQPSQSTQVTTEEAPTTVQAPKAETSRVDLPSEKAADKGIVGTQVDTTQPSNVSEIKPRMKRSADVTAASEKEVVEEAKVTGTDVTSKVKVEEGSEIVGHNNKETNVVNPHNAERVTLKYKWKFEDGIKPGDYFDFTLSNNVETHGISPLRKVPDIKSKDGQVMAVGEVNEERKIRYTFKEYVQGKKDLKAELDLNLFIDPTTVTKRGNQNIEVTLGEKKISKQFDIKYLDGVKDNWGVTVNGRIHTLNKQEGRFSHFAYVKPNNQSLTSVTVTGQVTSGYKQNAKNPTV

SEQ ID NO: 32142 - protein, 809 aa, Staphylococcus aureus 08BA02176; identical to SEQ ID NO: 31188

SEQ ID NO: 32143 - protein, 325 aa, Staphylococcus aureus 08BA02176; identical to SEQ ID NO: 30479

SEQ ID NO: 32144 - protein, 996 aa, Staphylococcus aureus 08BA02176
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSDYYSGPNAITDFEKAFPGSKITVDNTKNTIDVTIPQGYGSLNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIKTDANGIANIKALPSGDYILKEIEAPAPYIFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDATPEGYTKKENGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPETTSISGEKVWDDKDNQDGKRPEKVSVNLLANGEKVKTLDVTSETNWKYEFKNLPKYDEGKKIEYTVTEDHVKDYTTDINGTIITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 32145 - protein, 2182 aa, Staphylococcus aureus 08BA02176; identical to SEQ ID NO: 31178

SEQ ID NO: 32146 - protein, 689 aa, Staphylococcus aureus 08BA02176
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDSKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKAKAERYVPYSIAVNGTSTPNLSDLKFKGDSRVSYSDITKKVKSVLKHDRGIGERELKYAKKATYTVHFKNGTKKVINLNSKISQLNLLFVKDIKKIDVDVKTGSKAKADSYVPYTIAVNGTSTPIASKLKLSNKQLIGYQDLNKKVKSVLKHDRGINDIELKFAKQAKYTVHFKNGKTQVVDLKSDILTRNLFSVKDIKKIDIDVKQHTKSNKALNKVANIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 32147 - protein, 45 aa, Staphylococcus aureus 08BA02176; identical to SEQ ID NO: 31097

SEQ ID NO: 32148 - protein, 681 aa, Staphylococcus aureus 08BA02176; identical to SEQ ID NO: 31198

SEQ ID NO: 32149 - protein, 141 aa, Staphylococcus aureus 08BA02176; identical to SEQ ID NO: 31189

SEQ ID NO: 32150 - protein, 993 aa, Staphylococcus aureus 08BA02176
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTKDANSIATNSELKNPQTLDLPQSSPQTISNAQGTSKPSVRTRAVRSLTVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPDPEPSPEPEPEPTPDPEPSPEPEPEPTPDPEPSPEPEPEPTPDPEPSPDPDPDSDSDSDSGSDSDSDSDSDSDSDSDSDSDSDSESDSDSDSESDSESDSDSDSDSDSDSDSDSDSDSDSNSDSESDSDSDSDSDSDSDSDSDSDSDSDSDSDSDSDSDSGSDSDSDSDSDSDSDSDSDLDSDSDSESDSDSDSDSDSDSDSESDSDSDLDSDSDSDSDSDSDSDSDSENDSDSDSDSDSDSDSESDSDSDSDSDSDSDSDSESDSDSDSDSDSDSDSDSESDSDSDSDSDSDSDSDSESDSDSDSDSDSDSDSDSDSDSDSDSDSDSDSRVTPPNNEQKAPSNPKGEVNHSNKASKQHQTDALPETGDKSENTNATLFGAMMALLGSLLLFRKRKQDHKEKA

SEQ ID NO: 32151 - protein, 165 aa, Staphylococcus aureus 08BA02176; identical to SEQ ID NO: 31169

SEQ ID NO: 32152 - protein, 291 aa, Staphylococcus aureus 930918-3; identical to SEQ ID NO: 30390

SEQ ID NO: 32153 - protein, 62 aa, Staphylococcus aureus 930918-3
MYEQGGDIVKGYVKYYNDDEQNVEYDFYNLNGEYGREVLKMYADNKTINSDKLHLDIYLFKS

SEQ ID NO: 32154 - protein, 372 aa, Staphylococcus aureus 930918-3; identical to SEQ ID NO: 31084

SEQ ID NO: 32155 - protein, 309 aa, Staphylococcus aureus 930918-3; identical to SEQ ID NO: 30406

SEQ ID NO: 32156 - protein, 241 aa, Staphylococcus aureus 930918-3; identical to SEQ ID NO: 30738

SEQ ID NO: 32157 - protein, 241 aa, Staphylococcus aureus 930918-3; identical to SEQ ID NO: 30739

SEQ ID NO: 32158 - protein, 238 aa, Staphylococcus aureus 930918-3; identical to SEQ ID NO: 30740

SEQ ID NO: 32159 - protein, 319 aa, Staphylococcus aureus 930918-3; identical to SEQ ID NO: 30741

SEQ ID NO: 32160 - protein, 350 aa, Staphylococcus aureus 930918-3; identical to SEQ ID NO: 30602

SEQ ID NO: 32161 - protein, 645 aa, Staphylococcus aureus 930918-3; identical to SEQ ID NO: 30747

SEQ ID NO: 32162 - protein, 241 aa, Staphylococcus aureus 930918-3; identical to SEQ ID NO: 30776

SEQ ID NO: 32163 - protein, 141 aa, Staphylococcus aureus 930918-3; identical to SEQ ID NO: 30715

SEQ ID NO: 32164 - protein, 231 aa, Staphylococcus aureus 930918-3; identical to SEQ ID NO: 31073

SEQ ID NO: 32165 - protein, 234 aa, Staphylococcus aureus 930918-3; identical to SEQ ID NO: 31052

SEQ ID NO: 32166 - protein, 203 aa, Staphylococcus aureus 930918-3; identical to SEQ ID NO: 30770

SEQ ID NO: 32167 - protein, 434 aa, Staphylococcus aureus 930918-3 [sequence omitted]

SEQ ID NO: 32168 - protein, 44 aa, Staphylococcus aureus 930918-3; identical to SEQ ID NO: 30513

SEQ ID NO: 32169 - protein, 289 aa, Staphylococcus aureus 930918-3; identical to SEQ ID NO: 31685

SEQ ID NO: 32170 - protein, 338 aa, Staphylococcus aureus 930918-3; identical to SEQ ID NO: 30699

SEQ ID NO: 32171 - protein, 242 aa, Staphylococcus aureus 930918-3; identical to SEQ ID NO: 30537

SEQ ID NO: 32172 - protein, 242 aa, Staphylococcus aureus 930918-3; identical to SEQ ID NO: 30536

SEQ ID NO: 32173 - protein, 645 aa, Staphylococcus aureus A10102; identical to SEQ ID NO: 30908

SEQ ID NO: 32174 - protein, 434 aa, Staphylococcus aureus A10102 [sequence omitted]

SEQ ID NO: 32175 - protein, 905 aa, Staphylococcus aureus A10102; identical to SEQ ID NO: 30600

SEQ ID NO: 32176 - protein, 809 aa, Staphylococcus aureus A10102; identical to SEQ ID NO: 30632

SEQ ID NO: 32177 - protein, 141 aa, Staphylococcus aureus A10102; identical to SEQ ID NO: 30633

SEQ ID NO: 32178 - protein, 859 aa, Staphylococcus aureus A10102
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGRILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32179 - protein, 938 aa, Staphylococcus aureus A10102; identical to SEQ ID NO: 30838

SEQ ID NO: 32180 - protein, 1038 aa, Staphylococcus aureus A10102; identical to SEQ ID NO: 30590

SEQ ID NO: 32181 - protein, 233 aa, Staphylococcus aureus A10102; identical to SEQ ID NO: 30591

SEQ ID NO: 32182 - protein, 214 aa, Staphylococcus aureus A10102; identical to SEQ ID NO: 30966

SEQ ID NO: 32183 - protein, 203 aa, Staphylococcus aureus A10102
MFKKYDSKNSIVLKSILSLGIIYGGTFGIYPKADASTQKSSSVQDKQLQKVEEVPNNSEKALVKKLYDRYSKDTINGKSNKSRNWVYSERPLNENQVRIHLEGTYTVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 32184 - protein, 226 aa, Staphylococcus aureus A10102; identical to SEQ ID NO: 30577

SEQ ID NO: 32185 - protein, 231 aa, Staphylococcus aureus A10102; identical to SEQ ID NO: 30578

SEQ ID NO: 32186 - protein, 356 aa, Staphylococcus aureus A10102; identical to SEQ ID NO: 30579

SEQ ID NO: 32187 - protein, 292 aa, Staphylococcus aureus A10102; identical to SEQ ID NO: 30580

SEQ ID NO: 32188 - protein, 234 aa, Staphylococcus aureus A10102; identical to SEQ ID NO: 30581

SEQ ID NO: 32189 - protein, 231 aa, Staphylococcus aureus A10102; identical to SEQ ID NO: 30582

SEQ ID NO: 32190 - protein, 234 aa, Staphylococcus aureus A10102
MNMKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 32191 - protein, 232 aa, Staphylococcus aureus A10102; identical to SEQ ID NO: 30584

SEQ ID NO: 32192 - protein, 227 aa, Staphylococcus aureus A10102; identical to SEQ ID NO: 30585

SEQ ID NO: 32193 - protein, 227 aa, Staphylococcus aureus A10102; identical to SEQ ID NO: 30586

SEQ ID NO: 32194 - protein, 383 aa, Staphylococcus aureus A10102; identical to SEQ ID NO: 31488

SEQ ID NO: 32195 - protein, 705 aa, Staphylococcus aureus A10102
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSD

SEQ ID NO: 32196 - protein, 2271 aa, Staphylococcus aureus A10102; identical to SEQ ID NO: 30597

SEQ ID NO: 32197 - protein, 681 aa, Staphylococcus aureus A10102; identical to SEQ ID NO: 30598

SEQ ID NO: 32198 - protein, 891 aa, Staphylococcus aureus A10102; identical to SEQ ID NO: 30788

SEQ ID NO: 32199 - protein, 2186 aa, Staphylococcus aureus A10102
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTFINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 32200 - protein, 106 aa, Staphylococcus aureus A10102; identical to SEQ ID NO: 30624

SEQ ID NO: 32201 - protein, 167 aa, Staphylococcus aureus A10102
FISRPWFKRHRQYIQREKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 32202 - protein, 122 aa, Staphylococcus aureus A10102
MLEGIFTNSASAIEYSDLHHKSKFDSKRLSNAKMSFINPTQLENKNTNDRLLKHDLLFHDMFVNVASKKDFKVEFENEALSKKFINKNIDIYAGSYSYECHGGATNKTQCSYGGVTLSDNNK

SEQ ID NO: 32203 - protein, 291 aa, Staphylococcus aureus A10102; identical to SEQ ID NO: 30390

SEQ ID NO: 32204 - protein, 520 aa, Staphylococcus aureus A10102; identical to SEQ ID NO: 30906

SEQ ID NO: 32205 - protein, 243 aa, Staphylococcus aureus A10102
MKKLATVGSLIVTSTLVFSSMPFQNAHADTTSMNVPNKQSQNVQNHRPYGGVVPQGMTQAQYTELEKTLPQLSAGSNMQDYNMKLYDATQNIADKYNVIITTNVGVFKPHAVRDMNGHALPLTKDGNFYQTNVDANGVNHGGSEMVQNKTGHMSQQDHMNQNTHMNQQPQIQQGHMQSSNHQMMSPKANMHSSNHQMNQSNKKVLPAAGESMTSSILTASIAALLLVSGLFLAFRRRSTNKKT

SEQ ID NO: 32206 - protein, 321 aa, Staphylococcus aureus A10102; identical to SEQ ID NO: 30959

SEQ ID NO: 32207 - protein, 315 aa, Staphylococcus aureus A10102; identical to SEQ ID NO: 30573

SEQ ID NO: 32208 - protein, 325 aa, Staphylococcus aureus A10102; identical to SEQ ID NO: 30407

SEQ ID NO: 32209 - protein, 331 aa, Staphylococcus aureus A10102; identical to SEQ ID NO: 30615

SEQ ID NO: 32210 - protein, 327 aa, Staphylococcus aureus A10102; identical to SEQ ID NO: 30616

SEQ ID NO: 32211 - protein, 311 aa, Staphylococcus aureus A10102; identical to SEQ ID NO: 30617

SEQ ID NO: 32212 - protein, 258 aa, Staphylococcus aureus A10102; identical to SEQ ID NO: 30410

SEQ ID NO: 32213 - protein, 251 aa, Staphylococcus aureus A10102; identical to SEQ ID NO: 30946

SEQ ID NO: 32214 - protein, 136 aa, Staphylococcus aureus A10102; identical to SEQ ID NO: 30620

SEQ ID NO: 32215 - protein, 242 aa, Staphylococcus aureus A10102; identical to SEQ ID NO: 30399

SEQ ID NO: 32216 - protein, 239 aa, Staphylococcus aureus A10102; identical to SEQ ID NO: 30622

SEQ ID NO: 32217 - protein, 254 aa, Staphylococcus aureus A10102; identical to SEQ ID NO: 30809

SEQ ID NO: 32218 - protein, 645 aa, Staphylococcus aureus A10102; identical to SEQ ID NO: 30601

SEQ ID NO: 32219 - protein, 350 aa, Staphylococcus aureus A10102; identical to SEQ ID NO: 30602

SEQ ID NO: 32220 - protein, 109 aa, Staphylococcus aureus A10102; identical to SEQ ID NO: 30603

SEQ ID NO: 32221 - protein, 165 aa, Staphylococcus aureus A10102; identical to SEQ ID NO: 30418

SEQ ID NO: 32222 - protein, 51 aa, Staphylococcus aureus A10102
MSTTKDHHNKAKALPETGSENNGSNNATLFGGLFAALGSLLLFGRRKKQNK

SEQ ID NO: 32223 - protein, 274 aa, Staphylococcus aureus A10102; identical to SEQ ID NO: 30815

SEQ ID NO: 32224 - protein, 338 aa, Staphylococcus aureus A10102; identical to SEQ ID NO: 30627

SEQ ID NO: 32225 - protein, 351 aa, Staphylococcus aureus A10102; identical to SEQ ID NO: 30628

SEQ ID NO: 32226 - protein, 965 aa, Staphylococcus aureus A10102; identical to SEQ ID NO: 30920

SEQ ID NO: 32227 - protein, 971 aa, Staphylococcus aureus A10102
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDS

SEQ ID NO: 32228 - protein, 231 aa, Staphylococcus aureus A10102
MKKTLLASSLAVGLGIVAGNAGHEAHASEADLNKASLAQMAQSNDQTLNQKPIEAGAYNYTFDYEGFTYHFESDGTHFAWNYHATGANGANMSAQAPATNNVEPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGTGHWVTA

SEQ ID NO: 32229 - protein, 2481 aa, Staphylococcus aureus A10102
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQTVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 32230 - protein, 319 aa, Staphylococcus aureus A10102; identical to SEQ ID NO: 30605

SEQ ID NO: 32231 - protein, 238 aa, Staphylococcus aureus A10102; identical to SEQ ID NO: 30606

SEQ ID NO: 32232 - protein, 241 aa, Staphylococcus aureus A10102; identical to SEQ ID NO: 30607

SEQ ID NO: 32233 - protein, 241 aa, Staphylococcus aureus A10102; identical to SEQ ID NO: 30608

SEQ ID NO: 32234 - protein, 51 aa, Staphylococcus aureus A10102
MSTTKDHHNKAKALPETGNENSGSNNATLFGGLFAALGSLLLFGRRKKQNK

SEQ ID NO: 32235 - protein, 993 aa, Staphylococcus aureus A10102
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSD

SEQ ID NO: 32236 - protein, 111 aa, Staphylococcus aureus A10102
DSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32237 - protein, 231 aa, Staphylococcus aureus A5937; identical to SEQ ID NO: 30630

SEQ ID NO: 32238 - protein, 2481 aa, Staphylococcus aureus A5937
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNVNDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 32239 - protein, 110 aa, Staphylococcus aureus A5937
SDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32240 - protein, 1141 aa, Staphylococcus aureus A5937
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTILVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSD

SEQ ID NO: 32241 - protein, 68 aa, Staphylococcus aureus A5937
MNEKYKLYEQGGDIVKGYVKYHNDDEQNVEYDFYNLNGEYGYEVLKMYADNKTINRDKLHLDIYLFKS

SEQ ID NO: 32242 - protein, 157 aa, Staphylococcus aureus A5937; identical to SEQ ID NO: 30611

SEQ ID NO: 32243 - protein, 291 aa, Staphylococcus aureus A5937; identical to SEQ ID NO: 30390

SEQ ID NO: 32244 - protein, 214 aa, Staphylococcus aureus A5937; identical to SEQ ID NO: 30966

SEQ ID NO: 32245 - protein, 233 aa, Staphylococcus aureus A5937; identical to SEQ ID NO: 30591

SEQ ID NO: 32246 - protein, 1015 aa, Staphylococcus aureus A5937
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 32247 - protein, 444 aa, Staphylococcus aureus A5937; identical to SEQ ID NO: 30588

SEQ ID NO: 32248 - protein, 880 aa, Staphylococcus aureus A5937
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDS

SEQ ID NO: 32249 - protein, 905 aa, Staphylococcus aureus A5937; identical to SEQ ID NO: 30600

SEQ ID NO: 32250 - protein, 434 aa, Staphylococcus aureus A5937 [sequence omitted]

SEQ ID NO: 32251 - protein, 891 aa, Staphylococcus aureus A5937; identical to SEQ ID NO: 30788

SEQ ID NO: 32252 - protein, 2186 aa, Staphylococcus aureus A5937; identical to SEQ ID NO: 30789

SEQ ID NO: 32253 - protein, 331 aa, Staphylococcus aureus A5937
MSNQFKSEEERRQWEQFQAFQNQQNQQHQQYGQKKSKKGWFWGCGGCLVLFILIIIGISACTAGVTGNLGGNSSKEANKTHKIGETVKNGDLEVTVHSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDASTE

SEQ ID NO: 32254 - protein, 327 aa, Staphylococcus aureus A5937; identical to SEQ ID NO: 30616

SEQ ID NO: 32255 - protein, 311 aa, Staphylococcus aureus A5937; identical to SEQ ID NO: 30617

SEQ ID NO: 32256 - protein, 258 aa, Staphylococcus aureus A5937; identical to SEQ ID NO: 30410

SEQ ID NO: 32257 - protein, 251 aa, Staphylococcus aureus A5937; identical to SEQ ID NO: 30946

SEQ ID NO: 32258 - protein, 131 aa, Staphylococcus aureus A5937; identical to SEQ ID NO: 30867

SEQ ID NO: 32259 - protein, 242 aa, Staphylococcus aureus A5937; identical to SEQ ID NO: 30399

SEQ ID NO: 32260 - protein, 239 aa, Staphylococcus aureus A5937; identical to SEQ ID NO: 30622

SEQ ID NO: 32261 - protein, 254 aa, Staphylococcus aureus A5937; identical to SEQ ID NO: 30809

SEQ ID NO: 32262 - protein, 877 aa, Staphylococcus aureus A5937; identical to SEQ ID NO: 30593

SEQ ID NO: 32263 - protein, 2271 aa, Staphylococcus aureus A5937; identical to SEQ ID NO: 30597

SEQ ID NO: 32264 - protein, 681 aa, Staphylococcus aureus A5937; identical to SEQ ID NO: 30598

SEQ ID NO: 32265 - protein, 44 aa, Staphylococcus aureus A5937; identical to SEQ ID NO: 30513

SEQ ID NO: 32266 - protein, 351 aa, Staphylococcus aureus A5937; identical to SEQ ID NO: 30628

SEQ ID NO: 32267 - protein, 338 aa, Staphylococcus aureus A5937; identical to SEQ ID NO: 30627

SEQ ID NO: 32268 - protein, 274 aa, Staphylococcus aureus A5937; identical to SEQ ID NO: 30815

SEQ ID NO: 32269 - protein, 260 aa, Staphylococcus aureus A5937; identical to SEQ ID NO: 30625

SEQ ID NO: 32270 - protein, 96 aa, Staphylococcus aureus A5937; identical to SEQ ID NO: 30813

SEQ ID NO: 32271 - protein, 51 aa, Staphylococcus aureus A5937; identical to SEQ ID NO: 32234

SEQ ID NO: 32272 - protein, 462 aa, Staphylococcus aureus A5937
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKQQLTLKLI

SEQ ID NO: 32273 - protein, 383 aa, Staphylococcus aureus A5937; identical to SEQ ID NO: 31488

SEQ ID NO: 32274 - protein, 241 aa, Staphylococcus aureus A5937; identical to SEQ ID NO: 30608

SEQ ID NO: 32275 - protein, 241 aa, Staphylococcus aureus A5937; identical to SEQ ID NO: 30607

SEQ ID NO: 32276 - protein, 238 aa, Staphylococcus aureus A5937; identical to SEQ ID NO: 30606

SEQ ID NO: 32277 - protein, 319 aa, Staphylococcus aureus A5937; identical to SEQ ID NO: 30605

SEQ ID NO: 32278 - protein, 165 aa, Staphylococcus aureus A5937; identical to SEQ ID NO: 30418

SEQ ID NO: 32279 - protein, 109 aa, Staphylococcus aureus A5937; identical to SEQ ID NO: 30603

SEQ ID NO: 32280 - protein, 350 aa, Staphylococcus aureus A5937; identical to SEQ ID NO: 30602

SEQ ID NO: 32281 - protein, 645 aa, Staphylococcus aureus A5937; identical to SEQ ID NO: 30601

SEQ ID NO: 32282 - protein, 51 aa, Staphylococcus aureus A5937; identical to SEQ ID NO: 32222

SEQ ID NO: 32283 - protein, 283 aa, Staphylococcus aureus A5937
TEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32284 - protein, 325 aa, Staphylococcus aureus A5937; identical to SEQ ID NO: 30407

SEQ ID NO: 32285 - protein, 315 aa, Staphylococcus aureus A5937; identical to SEQ ID NO: 30573

SEQ ID NO: 32286 - protein, 321 aa, Staphylococcus aureus A5937; identical to SEQ ID NO: 30959

SEQ ID NO: 32287 - protein, 141 aa, Staphylococcus aureus A5937; identical to SEQ ID NO: 30633

SEQ ID NO: 32288 - protein, 809 aa, Staphylococcus aureus A5937; identical to SEQ ID NO: 30632

SEQ ID NO: 32289 - protein, 520 aa, Staphylococcus aureus A5937; identical to SEQ ID NO: 30906

SEQ ID NO: 32290 - protein, 241 aa, Staphylococcus aureus A5937; identical to SEQ ID NO: 30571

SEQ ID NO: 32291 - protein, 691 aa, Staphylococcus aureus A5937; identical to SEQ ID NO: 30511

SEQ ID NO: 32292 - protein, 203 aa, Staphylococcus aureus A5937; identical to SEQ ID NO: 30576

SEQ ID NO: 32293 - protein, 226 aa, Staphylococcus aureus A5937; identical to SEQ ID NO: 30577

SEQ ID NO: 32294 - protein, 231 aa, Staphylococcus aureus A5937; identical to SEQ ID NO: 30578

SEQ ID NO: 32295 - protein, 356 aa, Staphylococcus aureus A5937; identical to SEQ ID NO: 30579

SEQ ID NO: 32296 - protein, 292 aa, Staphylococcus aureus A5937; identical to SEQ ID NO: 30580

SEQ ID NO: 32297 - protein, 234 aa, Staphylococcus aureus A5937; identical to SEQ ID NO: 30581

SEQ ID NO: 32298 - protein, 231 aa, Staphylococcus aureus A5937; identical to SEQ ID NO: 30582

SEQ ID NO: 32299 - protein, 234 aa, Staphylococcus aureus A5937; identical to SEQ ID NO: 32190

SEQ ID NO: 32300 - protein, 232 aa, Staphylococcus aureus A5937; identical to SEQ ID NO: 30584

SEQ ID NO: 32301 - protein, 227 aa, Staphylococcus aureus A5937; identical to SEQ ID NO: 30585

SEQ ID NO: 32302 - protein, 227 aa, Staphylococcus aureus A5937; identical to SEQ ID NO: 30586

SEQ ID NO: 32303 - protein, 291 aa, Staphylococcus aureus A5948
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEVATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 32304 - protein, 234 aa, Staphylococcus aureus A5948; identical to SEQ ID NO: 30736

SEQ ID NO: 32305 - protein, 96 aa, Staphylococcus aureus A5948; identical to SEQ ID NO: 30813

SEQ ID NO: 32306 - protein, 141 aa, Staphylococcus aureus A5948; identical to SEQ ID NO: 30715

SEQ ID NO: 32307 - protein, 807 aa, Staphylococcus aureus A5948; identical to SEQ ID NO: 30716

SEQ ID NO: 32308 - protein, 895 aa, Staphylococcus aureus A5948; identical to SEQ ID NO: 30734

SEQ ID NO: 32309 - protein, 51 aa, Staphylococcus aureus A5948; identical to SEQ ID NO: 32222

SEQ ID NO: 32310 - protein, 55 aa, Staphylococcus aureus A5948
DKVKKSKIAKESVANQEKKRAELPKTGLESTQKGLIFSSIIGIAGLMLLARRRKN

SEQ ID NO: 32311 - protein, 325 aa, Staphylococcus aureus A5948; identical to SEQ ID NO: 30407

SEQ ID NO: 32312 - protein, 315 aa, Staphylococcus aureus A5948; identical to SEQ ID NO: 30440

SEQ ID NO: 32313 - protein, 321 aa, Staphylococcus aureus A5948
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYLYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 32314 - protein, 681 aa, Staphylococcus aureus A5948; identical to SEQ ID NO: 32025

SEQ ID NO: 32315 - protein, 2271 aa, Staphylococcus aureus A5948; identical to SEQ ID NO: 31839

SEQ ID NO: 32316 - protein, 741 aa, Staphylococcus aureus A5948
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFVDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSD

SEQ ID NO: 32317 - protein, 140 aa, Staphylococcus aureus A5948
SDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32318 - protein, 233 aa, Staphylococcus aureus A5948; identical to SEQ ID NO: 30428

SEQ ID NO: 32319 - protein, 645 aa, Staphylococcus aureus A5948; identical to SEQ ID NO: 30747

SEQ ID NO: 32320 - protein, 350 aa, Staphylococcus aureus A5948
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNYSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 32321 - protein, 109 aa, Staphylococcus aureus A5948; identical to SEQ ID NO: 30744

SEQ ID NO: 32322 - protein, 165 aa, Staphylococcus aureus A5948; identical to SEQ ID NO: 30742

SEQ ID NO: 32323 - protein, 319 aa, Staphylococcus aureus A5948; identical to SEQ ID NO: 30741

SEQ ID NO: 32324 - protein, 238 aa, Staphylococcus aureus A5948; identical to SEQ ID NO: 30740

SEQ ID NO: 32325 - protein, 241 aa, Staphylococcus aureus A5948; identical to SEQ ID NO: 30739

SEQ ID NO: 32326 - protein, 241 aa, Staphylococcus aureus A5948; identical to SEQ ID NO: 30738

SEQ ID NO: 32327 - protein, 331 aa, Staphylococcus aureus A5948
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEGLTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMPHSKPTTSEAPPSQNIHNEDSMYDASTE

SEQ ID NO: 32328 - protein, 909 aa, Staphylococcus aureus A5948
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 32329 - protein, 434 aa, Staphylococcus aureus A5948 [sequence omitted]

SEQ ID NO: 32330 - protein, 450 aa, Staphylococcus aureus A5948
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32331 - protein, 241 aa, Staphylococcus aureus A5948; identical to SEQ ID NO: 30776

SEQ ID NO: 32332 - protein, 2186 aa, Staphylococcus aureus A5948
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQIEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 32333 - protein, 274 aa, Staphylococcus aureus A5948; identical to SEQ ID NO: 30872

SEQ ID NO: 32334 - protein, 338 aa, Staphylococcus aureus A5948; identical to SEQ ID NO: 30699

SEQ ID NO: 32335 - protein, 351 aa, Staphylococcus aureus A5948; identical to SEQ ID NO: 30720

SEQ ID NO: 32336 - protein, 45 aa, Staphylococcus aureus A5948; identical to SEQ ID NO: 31097

SEQ ID NO: 32337 - protein, 2478 aa, Staphylococcus aureus A5948; identical to SEQ ID NO: 31939

SEQ ID NO: 32338 - protein, 225 aa, Staphylococcus aureus A5948; identical to SEQ ID NO: 30763

SEQ ID NO: 32339 - protein, 383 aa, Staphylococcus aureus A5948; identical to SEQ ID NO: 31779

SEQ ID NO: 32340 - protein, 311 aa, Staphylococcus aureus A5948; identical to SEQ ID NO: 30617

SEQ ID NO: 32341 - protein, 327 aa, Staphylococcus aureus A5948
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWSGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 32342 - protein, 1015 aa, Staphylococcus aureus A5948
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDS

SEQ ID NO: 32343 - protein, 1333 aa, Staphylococcus aureus A5948
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 32344 - protein, 935 aa, Staphylococcus aureus A5948
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 32345 - protein, 227 aa, Staphylococcus aureus A5948; identical to SEQ ID NO: 30585

SEQ ID NO: 32346 - protein, 232 aa, Staphylococcus aureus A5948; identical to SEQ ID NO: 30765

SEQ ID NO: 32347 - protein, 234 aa, Staphylococcus aureus A5948
MNMKFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 32348 - protein, 231 aa, Staphylococcus aureus A5948; identical to SEQ ID NO: 30560

SEQ ID NO: 32349 - protein, 231 aa, Staphylococcus aureus A5948; identical to SEQ ID NO: 31761

SEQ ID NO: 32350 - protein, 234 aa, Staphylococcus aureus A5948; identical to SEQ ID NO: 31052

SEQ ID NO: 32351 - protein, 308 aa, Staphylococcus aureus A5948; identical to SEQ ID NO: 31787

SEQ ID NO: 32352 - protein, 352 aa, Staphylococcus aureus A5948; identical to SEQ ID NO: 30767

SEQ ID NO: 32353 - protein, 231 aa, Staphylococcus aureus A5948; identical to SEQ ID NO: 30768

SEQ ID NO: 32354 - protein, 226 aa, Staphylococcus aureus A5948; identical to SEQ ID NO: 30769

SEQ ID NO: 32355 - protein, 203 aa, Staphylococcus aureus A5948; identical to SEQ ID NO: 30770

SEQ ID NO: 32356 - protein, 690 aa, Staphylococcus aureus A5948
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTHNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 32357 - protein, 231 aa, Staphylococcus aureus A5948; identical to SEQ ID NO: 31073

SEQ ID NO: 32358 - protein, 917 aa, Staphylococcus aureus A5948; identical to SEQ ID NO: 31037

SEQ ID NO: 32359 - protein, 995 aa, Staphylococcus aureus A5948; identical to SEQ ID NO: 31038

SEQ ID NO: 32360 - protein, 241 aa, Staphylococcus aureus A6224; identical to SEQ ID NO: 30571

SEQ ID NO: 32361 - protein, 520 aa, Staphylococcus aureus A6224
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSDAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32362 - protein, 351 aa, Staphylococcus aureus A6224; identical to SEQ ID NO: 30628

SEQ ID NO: 32363 - protein, 338 aa, Staphylococcus aureus A6224; identical to SEQ ID NO: 30627

SEQ ID NO: 32364 - protein, 274 aa, Staphylococcus aureus A6224; identical to SEQ ID NO: 30815

SEQ ID NO: 32365 - protein, 260 aa, Staphylococcus aureus A6224; identical to SEQ ID NO: 30625

SEQ ID NO: 32366 - protein, 203 aa, Staphylococcus aureus A6224; identical to SEQ ID NO: 30576

SEQ ID NO: 32367 - protein, 226 aa, Staphylococcus aureus A6224; identical to SEQ ID NO: 30577

SEQ ID NO: 32368 - protein, 231 aa, Staphylococcus aureus A6224; identical to SEQ ID NO: 30578

SEQ ID NO: 32369 - protein, 356 aa, Staphylococcus aureus A6224; identical to SEQ ID NO: 30579

SEQ ID NO: 32370 - protein, 292 aa, Staphylococcus aureus A6224; identical to SEQ ID NO: 30580

SEQ ID NO: 32371 - protein, 234 aa, Staphylococcus aureus A6224; identical to SEQ ID NO: 30581

SEQ ID NO: 32372 - protein, 231 aa, Staphylococcus aureus A6224; identical to SEQ ID NO: 30582

SEQ ID NO: 32373 - protein, 234 aa, Staphylococcus aureus A6224; identical to SEQ ID NO: 32190

SEQ ID NO: 32374 - protein, 232 aa, Staphylococcus aureus A6224; identical to SEQ ID NO: 30584

SEQ ID NO: 32375 - protein, 227 aa, Staphylococcus aureus A6224; identical to SEQ ID NO: 30585

SEQ ID NO: 32376 - protein, 227 aa, Staphylococcus aureus A6224; identical to SEQ ID NO: 30586

SEQ ID NO: 32377 - protein, 254 aa, Staphylococcus aureus A6224; identical to SEQ ID NO: 30809

SEQ ID NO: 32378 - protein, 239 aa, Staphylococcus aureus A6224; identical to SEQ ID NO: 30622

SEQ ID NO: 32379 - protein, 242 aa, Staphylococcus aureus A6224; identical to SEQ ID NO: 30399

SEQ ID NO: 32380 - protein, 251 aa, Staphylococcus aureus A6224; identical to SEQ ID NO: 30946

SEQ ID NO: 32381 - protein, 258 aa, Staphylococcus aureus A6224; identical to SEQ ID NO: 30410

SEQ ID NO: 32382 - protein, 311 aa, Staphylococcus aureus A6224; identical to SEQ ID NO: 30617

SEQ ID NO: 32383 - protein, 327 aa, Staphylococcus aureus A6224; identical to SEQ ID NO: 30616

SEQ ID NO: 32384 - protein, 331 aa, Staphylococcus aureus A6224; identical to SEQ ID NO: 30615

SEQ ID NO: 32385 - protein, 1974 aa, Staphylococcus aureus A6224
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKND

SEQ ID NO: 32386 - protein, 891 aa, Staphylococcus aureus A6224; identical to SEQ ID NO: 30788

SEQ ID NO: 32387 - protein, 2481 aa, Staphylococcus aureus A6224
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTIASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 32388 - protein, 751 aa, Staphylococcus aureus A6224
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSD

SEQ ID NO: 32389 - protein, 645 aa, Staphylococcus aureus A6224; identical to SEQ ID NO: 30908

SEQ ID NO: 32390 - protein, 122 aa, Staphylococcus aureus A6224; identical to SEQ ID NO: 32202

SEQ ID NO: 32391 - protein, 291 aa, Staphylococcus aureus A6224
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALVDTLDATIQKKGLLSNRGSRQENYQVLRQTKVPAVLLELGYISNPTDETMIKDQLHRQILEQAIVDGLKIYFSA

SEQ ID NO: 32392 - protein, 1038 aa, Staphylococcus aureus A6224
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 32393 - protein, 665 aa, Staphylococcus aureus A6224
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGD

SEQ ID NO: 32394 - protein, 214 aa, Staphylococcus aureus A6224; identical to SEQ ID NO: 30966

SEQ ID NO: 32395 - protein, 233 aa, Staphylococcus aureus A6224; identical to SEQ ID NO: 30591

SEQ ID NO: 32396 - protein, 681 aa, Staphylococcus aureus A6224; identical to SEQ ID NO: 30598

SEQ ID NO: 32397 - protein, 2271 aa, Staphylococcus aureus A6224; identical to SEQ ID NO: 30597

SEQ ID NO: 32398 - protein, 751 aa, Staphylococcus aureus A6224
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32399 - protein, 388 aa, Staphylococcus aureus A6224
MHYVIMFIYYCKECSIMNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 32400 - protein, 241 aa, Staphylococcus aureus A6224; identical to SEQ ID NO: 30608

SEQ ID NO: 32401 - protein, 241 aa, Staphylococcus aureus A6224; identical to SEQ ID NO: 30607

SEQ ID NO: 32402 - protein, 238 aa, Staphylococcus aureus A6224; identical to SEQ ID NO: 30606

SEQ ID NO: 32403 - protein, 319 aa, Staphylococcus aureus A6224; identical to SEQ ID NO: 30605

SEQ ID NO: 32404 - protein, 905 aa, Staphylococcus aureus A6224; identical to SEQ ID NO: 30600

SEQ ID NO: 32405 - protein, 434 aa, Staphylococcus aureus A6224 [sequence omitted]

SEQ ID NO: 32406 - protein, 165 aa, Staphylococcus aureus A6224; identical to SEQ ID NO: 30418

SEQ ID NO: 32407 - protein, 109 aa, Staphylococcus aureus A6224; identical to SEQ ID NO: 30603

SEQ ID NO: 32408 - protein, 350 aa, Staphylococcus aureus A6224; identical to SEQ ID NO: 30602

SEQ ID NO: 32409 - protein, 645 aa, Staphylococcus aureus A6224; identical to SEQ ID NO: 30601

SEQ ID NO: 32410 - protein, 174 aa, Staphylococcus aureus A6224
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDPDSDSDSDSDSDSDSDAGKHTPVKPMSTTKDHHNKAKALPETGSENNGSNNATLFGGLFAALGSLLLFGRRKKQNK

SEQ ID NO: 32411 - protein, 231 aa, Staphylococcus aureus A6224; identical to SEQ ID NO: 30630

SEQ ID NO: 32412 - protein, 188 aa, Staphylococcus aureus A6224
SDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32413 - protein, 1337 aa, Staphylococcus aureus A6224; identical to SEQ ID NO: 30811

SEQ ID NO: 32414 - protein, 976 aa, Staphylococcus aureus A6224
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDS

SEQ ID NO: 32415 - protein, 809 aa, Staphylococcus aureus A6224; identical to SEQ ID NO: 30632

SEQ ID NO: 32416 - protein, 141 aa, Staphylococcus aureus A6224; identical to SEQ ID NO: 30633

SEQ ID NO: 32417 - protein, 321 aa, Staphylococcus aureus A6224; identical to SEQ ID NO: 30959

SEQ ID NO: 32418 - protein, 315 aa, Staphylococcus aureus A6224; identical to SEQ ID NO: 30573

SEQ ID NO: 32419 - protein, 325 aa, Staphylococcus aureus A6224; identical to SEQ ID NO: 30407

SEQ ID NO: 32420 - protein, 246 aa, Staphylococcus aureus A6224
MTKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32421 - protein, 203 aa, Staphylococcus aureus A6300; identical to SEQ ID NO: 30576

SEQ ID NO: 32422 - protein, 226 aa, Staphylococcus aureus A6300; identical to SEQ ID NO: 30577

SEQ ID NO: 32423 - protein, 231 aa, Staphylococcus aureus A6300; identical to SEQ ID NO: 30578

SEQ ID NO: 32424 - protein, 356 aa, Staphylococcus aureus A6300
MNMKTITKTSLALGLLTTGAITVTTQSVKAEKIQSTKVDKVPTLKAERLAMINITAGANSATTQAANTRQERTPKLEKAPNTNEEKTSASKIEKISQPKQEEQKSLNISAMPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 32425 - protein, 292 aa, Staphylococcus aureus A6300; identical to SEQ ID NO: 30580

SEQ ID NO: 32426 - protein, 234 aa, Staphylococcus aureus A6300; identical to SEQ ID NO: 30581

SEQ ID NO: 32427 - protein, 231 aa, Staphylococcus aureus A6300; identical to SEQ ID NO: 30582

SEQ ID NO: 32428 - protein, 234 aa, Staphylococcus aureus A6300; identical to SEQ ID NO: 32190

SEQ ID NO: 32429 - protein, 232 aa, Staphylococcus aureus A6300; identical to SEQ ID NO: 30584

SEQ ID NO: 32430 - protein, 227 aa, Staphylococcus aureus A6300; identical to SEQ ID NO: 30585

SEQ ID NO: 32431 - protein, 241 aa, Staphylococcus aureus A6300; identical to SEQ ID NO: 30571

SEQ ID NO: 32432 - protein, 520 aa, Staphylococcus aureus A6300; identical to SEQ ID NO: 30906

SEQ ID NO: 32433 - protein, 2481 aa, Staphylococcus aureus A6300; identical to SEQ ID NO: 30631

SEQ ID NO: 32434 - protein, 330 aa, Staphylococcus aureus A6300
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 32435 - protein, 338 aa, Staphylococcus aureus A6300; identical to SEQ ID NO: 30627

SEQ ID NO: 32436 - protein, 351 aa, Staphylococcus aureus A6300; identical to SEQ ID NO: 30628

SEQ ID NO: 32437 - protein, 233 aa, Staphylococcus aureus A6300; identical to SEQ ID NO: 30591

SEQ ID NO: 32438 - protein, 1038 aa, Staphylococcus aureus A6300; identical to SEQ ID NO: 30590

SEQ ID NO: 32439 - protein, 961 aa, Staphylococcus aureus A6300
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNTTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 32440 - protein, 443 aa, Staphylococcus aureus A6300
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNP

SEQ ID NO: 32441 - protein, 227 aa, Staphylococcus aureus A6300; identical to SEQ ID NO: 30586

SEQ ID NO: 32442 - protein, 231 aa, Staphylococcus aureus A6300; identical to SEQ ID NO: 30630

SEQ ID NO: 32443 - protein, 905 aa, Staphylococcus aureus A6300; identical to SEQ ID NO: 30600

SEQ ID NO: 32444 - protein, 434 aa, Staphylococcus aureus A6300 [sequence omitted]

SEQ ID NO: 32445 - protein, 891 aa, Staphylococcus aureus A6300; identical to SEQ ID NO: 30788

SEQ ID NO: 32446 - protein, 2186 aa, Staphylococcus aureus A6300; identical to SEQ ID NO: 30789

SEQ ID NO: 32447 - protein, 331 aa, Staphylococcus aureus A6300; identical to SEQ ID NO: 30615

SEQ ID NO: 32448 - protein, 645 aa, Staphylococcus aureus A6300; identical to SEQ ID NO: 30601

SEQ ID NO: 32449 - protein, 350 aa, Staphylococcus aureus A6300; identical to SEQ ID NO: 30602

SEQ ID NO: 32450 - protein, 109 aa, Staphylococcus aureus A6300; identical to SEQ ID NO: 30603

SEQ ID NO: 32451 - protein, 165 aa, Staphylococcus aureus A6300; identical to SEQ ID NO: 30418

SEQ ID NO: 32452 - protein, 877 aa, Staphylococcus aureus A6300; identical to SEQ ID NO: 30593

SEQ ID NO: 32453 - protein, 2271 aa, Staphylococcus aureus A6300; identical to SEQ ID NO: 30597

SEQ ID NO: 32454 - protein, 681 aa, Staphylococcus aureus A6300; identical to SEQ ID NO: 30598

SEQ ID NO: 32455 - protein, 1117 aa, Staphylococcus aureus A6300
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 32456 - protein, 1337 aa, Staphylococcus aureus A6300; identical to SEQ ID NO: 30811

SEQ ID NO: 32457 - protein, 947 aa, Staphylococcus aureus A6300
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32458 - protein, 241 aa, Staphylococcus aureus A6300
VNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32459 - protein, 325 aa, Staphylococcus aureus A6300; identical to SEQ ID NO: 30407

SEQ ID NO: 32460 - protein, 315 aa, Staphylococcus aureus A6300
MLKNKILATTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINHLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 32461 - protein, 321 aa, Staphylococcus aureus A6300; identical to SEQ ID NO: 30959

SEQ ID NO: 32462 - protein, 141 aa, Staphylococcus aureus A6300; identical to SEQ ID NO: 30633

SEQ ID NO: 32463 - protein, 809 aa, Staphylococcus aureus A6300; identical to SEQ ID NO: 30632

SEQ ID NO: 32464 - protein, 110 aa, Staphylococcus aureus A6300
MEYSDLHHKSKFDSKRLSNAKMSFINPTQLENKNTNDRLLKHDLLFHDMFVNVASKKDFKVEFENEALSKKFINKNIDIYAGSYSYECHGGATNKTQCSYGGVTLSDNNK

SEQ ID NO: 32465 - protein, 291 aa, Staphylococcus aureus A6300; identical to SEQ ID NO: 30390

SEQ ID NO: 32466 - protein, 645 aa, Staphylococcus aureus A6300; identical to SEQ ID NO: 30908

SEQ ID NO: 32467 - protein, 327 aa, Staphylococcus aureus A6300; identical to SEQ ID NO: 30616

SEQ ID NO: 32468 - protein, 311 aa, Staphylococcus aureus A6300; identical to SEQ ID NO: 30617

SEQ ID NO: 32469 - protein, 258 aa, Staphylococcus aureus A6300; identical to SEQ ID NO: 30410

SEQ ID NO: 32470 - protein, 251 aa, Staphylococcus aureus A6300; identical to SEQ ID NO: 30946

SEQ ID NO: 32471 - protein, 242 aa, Staphylococcus aureus A6300; identical to SEQ ID NO: 30399

SEQ ID NO: 32472 - protein, 239 aa, Staphylococcus aureus A6300; identical to SEQ ID NO: 30622

SEQ ID NO: 32473 - protein, 254 aa, Staphylococcus aureus A6300; identical to SEQ ID NO: 30809

SEQ ID NO: 32474 - protein, 388 aa, Staphylococcus aureus A6300; identical to SEQ ID NO: 32399

SEQ ID NO: 32475 - protein, 241 aa, Staphylococcus aureus A6300; identical to SEQ ID NO: 30608

SEQ ID NO: 32476 - protein, 241 aa, Staphylococcus aureus A6300; identical to SEQ ID NO: 30607

SEQ ID NO: 32477 - protein, 238 aa, Staphylococcus aureus A6300; identical to SEQ ID NO: 30606

SEQ ID NO: 32478 - protein, 319 aa, Staphylococcus aureus A6300; identical to SEQ ID NO: 30605

SEQ ID NO: 32479 - protein, 231 aa, Staphylococcus aureus A8115; identical to SEQ ID NO: 30630

SEQ ID NO: 32480 - protein, 989 aa, Staphylococcus aureus A8115; identical to SEQ ID NO: 31697

SEQ ID NO: 32481 - protein, 434 aa, Staphylococcus aureus A8115 [sequence omitted]

SEQ ID NO: 32482 - protein, 948 aa, Staphylococcus aureus A8115
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDS

SEQ ID NO: 32483 - protein, 51 aa, Staphylococcus aureus A8115; identical to SEQ ID NO: 32234

SEQ ID NO: 32484 - protein, 1177 aa, Staphylococcus aureus A8115
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSD

SEQ ID NO: 32485 - protein, 160 aa, Staphylococcus aureus A8115
SDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32486 - protein, 181 aa, Staphylococcus aureus A8115
DSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32487 - protein, 63 aa, Staphylococcus aureus A8115
DSDAGKHTPVKPMSTTKDHHNKAKALPETGSENNGSNNATLFGGLFAALGSLLLFGRRKKQNK

SEQ ID NO: 32488 - protein, 2481 aa, Staphylococcus aureus A8115; identical to SEQ ID NO: 31413

SEQ ID NO: 32489 - protein, 321 aa, Staphylococcus aureus A8115; identical to SEQ ID NO: 30959

SEQ ID NO: 32490 - protein, 315 aa, Staphylococcus aureus A8115; identical to SEQ ID NO: 30573

SEQ ID NO: 32491 - protein, 325 aa, Staphylococcus aureus A8115; identical to SEQ ID NO: 30407

SEQ ID NO: 32492 - protein, 246 aa, Staphylococcus aureus A8115; identical to SEQ ID NO: 32420

SEQ ID NO: 32493 - protein, 809 aa, Staphylococcus aureus A8115; identical to SEQ ID NO: 30632

SEQ ID NO: 32494 - protein, 141 aa, Staphylococcus aureus A8115; identical to SEQ ID NO: 30633

SEQ ID NO: 32495 - protein, 961 aa, Staphylococcus aureus A8115; identical to SEQ ID NO: 30589

SEQ ID NO: 32496 - protein, 1038 aa, Staphylococcus aureus A8115; identical to SEQ ID NO: 30590

SEQ ID NO: 32497 - protein, 233 aa, Staphylococcus aureus A8115; identical to SEQ ID NO: 30591

SEQ ID NO: 32498 - protein, 214 aa, Staphylococcus aureus A8115; identical to SEQ ID NO: 30966

SEQ ID NO: 32499 - protein, 467 aa, Staphylococcus aureus A8115
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITT

SEQ ID NO: 32500 - protein, 261 aa, Staphylococcus aureus A8115
MIFSLTLTLLITPLVYSDSKNETIKEKNLHKKSELSSITLNNLRHIYFFNEKGISEKIMTEDQFLDYTLLFKSFFISHSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFDGKIQKGLIVFHTSKEPLVSYDLFNVIGQYPDKLLKIYQDNKIIESENMHIDIYLYTSLIVLISLPLVL

SEQ ID NO: 32501 - protein, 259 aa, Staphylococcus aureus A8115; identical to SEQ ID NO: 30226

SEQ ID NO: 32502 - protein, 179 aa, Staphylococcus aureus A8115; identical to SEQ ID NO: 30225

SEQ ID NO: 32503 - protein, 645 aa, Staphylococcus aureus A8115; identical to SEQ ID NO: 30601

SEQ ID NO: 32504 - protein, 350 aa, Staphylococcus aureus A8115; identical to SEQ ID NO: 30602

SEQ ID NO: 32505 - protein, 109 aa, Staphylococcus aureus A8115; identical to SEQ ID NO: 30603

SEQ ID NO: 32506 - protein, 165 aa, Staphylococcus aureus A8115; identical to SEQ ID NO: 30418

SEQ ID NO: 32507 - protein, 96 aa, Staphylococcus aureus A8115; identical to SEQ ID NO: 30813

SEQ ID NO: 32508 - protein, 68 aa, Staphylococcus aureus A8115; identical to SEQ ID NO: 32241

SEQ ID NO: 32509 - protein, 157 aa, Staphylococcus aureus A8115; identical to SEQ ID NO: 30611

SEQ ID NO: 32510 - protein, 291 aa, Staphylococcus aureus A8115; identical to SEQ ID NO: 30390

SEQ ID NO: 32511 - protein, 891 aa, Staphylococcus aureus A8115; identical to SEQ ID NO: 30788

SEQ ID NO: 32512 - protein, 2186 aa, Staphylococcus aureus A8115; identical to SEQ ID NO: 30516

SEQ ID NO: 32513 - protein, 331 aa, Staphylococcus aureus A8115; identical to SEQ ID NO: 30615

SEQ ID NO: 32514 - protein, 327 aa, Staphylococcus aureus A8115; identical to SEQ ID NO: 30616

SEQ ID NO: 32515 - protein, 311 aa, Staphylococcus aureus A8115; identical to SEQ ID NO: 30617

SEQ ID NO: 32516 - protein, 258 aa, Staphylococcus aureus A8115; identical to SEQ ID NO: 30410

SEQ ID NO: 32517 - protein, 251 aa, Staphylococcus aureus A8115; identical to SEQ ID NO: 30946

SEQ ID NO: 32518 - protein, 131 aa, Staphylococcus aureus A8115; identical to SEQ ID NO: 30867

SEQ ID NO: 32519 - protein, 242 aa, Staphylococcus aureus A8115; identical to SEQ ID NO: 30399

SEQ ID NO: 32520 - protein, 239 aa, Staphylococcus aureus A8115
MKRILIIVVLLFCYSQNHIATADVGVLNLRNYYGSYPIEDHQSINPENNHLSHQLVFSMDNSTVTAEFKNVDDVKKFKNHAVDVYGLSYSGYCLKNKYIYGGVTFAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 32521 - protein, 254 aa, Staphylococcus aureus A8115; identical to SEQ ID NO: 30809

SEQ ID NO: 32522 - protein, 241 aa, Staphylococcus aureus A8115; identical to SEQ ID NO: 30571

SEQ ID NO: 32523 - protein, 236 aa, Staphylococcus aureus A8115
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAF

SEQ ID NO: 32524 - protein, 296 aa, Staphylococcus aureus A8115
MNLKHRKRITNSTKNNKMLSNEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32525 - protein, 681 aa, Staphylococcus aureus A8115; identical to SEQ ID NO: 30598

SEQ ID NO: 32526 - protein, 2037 aa, Staphylococcus aureus A8115
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 32527 - protein, 695 aa, Staphylococcus aureus A8115
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSD

SEQ ID NO: 32528 - protein, 759 aa, Staphylococcus aureus A8115
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSESDSD

SEQ ID NO: 32529 - protein, 691 aa, Staphylococcus aureus A8115; identical to SEQ ID NO: 30511

SEQ ID NO: 32530 - protein, 203 aa, Staphylococcus aureus A8115
MFKKYDSKNSIVLKSILSLGIIHGGTFGIYPKADASTQNSSSVQDKQLQKVEEVPNNSEKALVKKLYDRYSKDTINGKSNKSRNWVYSERPLNENQVRIHLEGTYTVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 32531 - protein, 226 aa, Staphylococcus aureus A8115; identical to SEQ ID NO: 30577

SEQ ID NO: 32532 - protein, 231 aa, Staphylococcus aureus A8115; identical to SEQ ID NO: 30578

SEQ ID NO: 32533 - protein, 356 aa, Staphylococcus aureus A8115; identical to SEQ ID NO: 30793

SEQ ID NO: 32534 - protein, 292 aa, Staphylococcus aureus A8115; identical to SEQ ID NO: 30580

SEQ ID NO: 32535 - protein, 234 aa, Staphylococcus aureus A8115; identical to SEQ ID NO: 30581

SEQ ID NO: 32536 - protein, 231 aa, Staphylococcus aureus A8115; identical to SEQ ID NO: 30582

SEQ ID NO: 32537 - protein, 234 aa, Staphylococcus aureus A8115; identical to SEQ ID NO: 32190

SEQ ID NO: 32538 - protein, 232 aa, Staphylococcus aureus A8115; identical to SEQ ID NO: 30584

SEQ ID NO: 32539 - protein, 227 aa, Staphylococcus aureus A8115; identical to SEQ ID NO: 30585

SEQ ID NO: 32540 - protein, 227 aa, Staphylococcus aureus A8115; identical to SEQ ID NO: 30586

SEQ ID NO: 32541 - protein, 351 aa, Staphylococcus aureus A8115; identical to SEQ ID NO: 30628

SEQ ID NO: 32542 - protein, 338 aa, Staphylococcus aureus A8115; identical to SEQ ID NO: 30627

SEQ ID NO: 32543 - protein, 274 aa, Staphylococcus aureus A8115; identical to SEQ ID NO: 30872

SEQ ID NO: 32544 - protein, 319 aa, Staphylococcus aureus A8115; identical to SEQ ID NO: 30605

SEQ ID NO: 32545 - protein, 238 aa, Staphylococcus aureus A8115; identical to SEQ ID NO: 30606

SEQ ID NO: 32546 - protein, 241 aa, Staphylococcus aureus A8115; identical to SEQ ID NO: 30607

SEQ ID NO: 32547 - protein, 241 aa, Staphylococcus aureus A8115; identical to SEQ ID NO: 30608

SEQ ID NO: 32548 - protein, 388 aa, Staphylococcus aureus A8115; identical to SEQ ID NO: 32399

SEQ ID NO: 32549 - protein, 319 aa, Staphylococcus aureus A8117; identical to SEQ ID NO: 30605

SEQ ID NO: 32550 - protein, 238 aa, Staphylococcus aureus A8117; identical to SEQ ID NO: 30606

SEQ ID NO: 32551 - protein, 241 aa, Staphylococcus aureus A8117; identical to SEQ ID NO: 30607

SEQ ID NO: 32552 - protein, 241 aa, Staphylococcus aureus A8117; identical to SEQ ID NO: 30608

SEQ ID NO: 32553 - protein, 383 aa, Staphylococcus aureus A8117; identical to SEQ ID NO: 31488

SEQ ID NO: 32554 - protein, 68 aa, Staphylococcus aureus A8117; identical to SEQ ID NO: 32241

SEQ ID NO: 32555 - protein, 157 aa, Staphylococcus aureus A8117; identical to SEQ ID NO: 30611

SEQ ID NO: 32556 - protein, 291 aa, Staphylococcus aureus A8117; identical to SEQ ID NO: 30390

SEQ ID NO: 32557 - protein, 891 aa, Staphylococcus aureus A8117; identical to SEQ ID NO: 30788

SEQ ID NO: 32558 - protein, 2186 aa, Staphylococcus aureus A8117; identical to SEQ ID NO: 30516

SEQ ID NO: 32559 - protein, 331 aa, Staphylococcus aureus A8117; identical to SEQ ID NO: 30615

SEQ ID NO: 32560 - protein, 327 aa, Staphylococcus aureus A8117; identical to SEQ ID NO: 30616

SEQ ID NO: 32561 - protein, 311 aa, Staphylococcus aureus A8117; identical to SEQ ID NO: 30617

SEQ ID NO: 32562 - protein, 258 aa, Staphylococcus aureus A8117; identical to SEQ ID NO: 30410

SEQ ID NO: 32563 - protein, 251 aa, Staphylococcus aureus A8117; identical to SEQ ID NO: 30946

SEQ ID NO: 32564 - protein, 136 aa, Staphylococcus aureus A8117; identical to SEQ ID NO: 30620

SEQ ID NO: 32565 - protein, 242 aa, Staphylococcus aureus A8117; identical to SEQ ID NO: 30399

SEQ ID NO: 32566 - protein, 239 aa, Staphylococcus aureus A8117; identical to SEQ ID NO: 32520

SEQ ID NO: 32567 - protein, 254 aa, Staphylococcus aureus A8117; identical to SEQ ID NO: 30809

SEQ ID NO: 32568 - protein, 691 aa, Staphylococcus aureus A8117; identical to SEQ ID NO: 30511

SEQ ID NO: 32569 - protein, 203 aa, Staphylococcus aureus A8117; identical to SEQ ID NO: 32530

SEQ ID NO: 32570 - protein, 226 aa, Staphylococcus aureus A8117; identical to SEQ ID NO: 30577

SEQ ID NO: 32571 - protein, 231 aa, Staphylococcus aureus A8117; identical to SEQ ID NO: 30578

SEQ ID NO: 32572 - protein, 356 aa, Staphylococcus aureus A8117; identical to SEQ ID NO: 30793

SEQ ID NO: 32573 - protein, 292 aa, Staphylococcus aureus A8117; identical to SEQ ID NO: 30580

SEQ ID NO: 32574 - protein, 234 aa, Staphylococcus aureus A8117; identical to SEQ ID NO: 30581

SEQ ID NO: 32575 - protein, 231 aa, Staphylococcus aureus A8117; identical to SEQ ID NO: 30582

SEQ ID NO: 32576 - protein, 234 aa, Staphylococcus aureus A8117; identical to SEQ ID NO: 32190

SEQ ID NO: 32577 - protein, 232 aa, Staphylococcus aureus A8117; identical to SEQ ID NO: 30584

SEQ ID NO: 32578 - protein, 227 aa, Staphylococcus aureus A8117; identical to SEQ ID NO: 30585

SEQ ID NO: 32579 - protein, 227 aa, Staphylococcus aureus A8117; identical to SEQ ID NO: 30586

SEQ ID NO: 32580 - protein, 321 aa, Staphylococcus aureus A8117; identical to SEQ ID NO: 30959

SEQ ID NO: 32581 - protein, 315 aa, Staphylococcus aureus A8117; identical to SEQ ID NO: 30573

SEQ ID NO: 32582 - protein, 325 aa, Staphylococcus aureus A8117; identical to SEQ ID NO: 30407

SEQ ID NO: 32583 - protein, 348 aa, Staphylococcus aureus A8117
PKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32584 - protein, 809 aa, Staphylococcus aureus A8117; identical to SEQ ID NO: 30632

SEQ ID NO: 32585 - protein, 141 aa, Staphylococcus aureus A8117; identical to SEQ ID NO: 30633

SEQ ID NO: 32586 - protein, 645 aa, Staphylococcus aureus A8117; identical to SEQ ID NO: 30601

SEQ ID NO: 32587 - protein, 350 aa, Staphylococcus aureus A8117; identical to SEQ ID NO: 30602

SEQ ID NO: 32588 - protein, 109 aa, Staphylococcus aureus A8117; identical to SEQ ID NO: 30603

SEQ ID NO: 32589 - protein, 165 aa, Staphylococcus aureus A8117; identical to SEQ ID NO: 30418

SEQ ID NO: 32590 - protein, 810 aa, Staphylococcus aureus A8117
MIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32591 - protein, 2037 aa, Staphylococcus aureus A8117; identical to SEQ ID NO: 32526

SEQ ID NO: 32592 - protein, 681 aa, Staphylococcus aureus A8117; identical to SEQ ID NO: 30598

SEQ ID NO: 32593 - protein, 512 aa, Staphylococcus aureus A8117
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32594 - protein, 241 aa, Staphylococcus aureus A8117; identical to SEQ ID NO: 30571

SEQ ID NO: 32595 - protein, 96 aa, Staphylococcus aureus A8117; identical to SEQ ID NO: 30813

SEQ ID NO: 32596 - protein, 330 aa, Staphylococcus aureus A8117; identical to SEQ ID NO: 30381

SEQ ID NO: 32597 - protein, 338 aa, Staphylococcus aureus A8117; identical to SEQ ID NO: 30627

SEQ ID NO: 32598 - protein, 351 aa, Staphylococcus aureus A8117; identical to SEQ ID NO: 30628

SEQ ID NO: 32599 - protein, 307 aa, Staphylococcus aureus A8117
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 32600 - protein, 231 aa, Staphylococcus aureus A8117; identical to SEQ ID NO: 30630

SEQ ID NO: 32601 - protein, 2481 aa, Staphylococcus aureus A8117; identical to SEQ ID NO: 31413

SEQ ID NO: 32602 - protein, 233 aa, Staphylococcus aureus A8117; identical to SEQ ID NO: 30591

SEQ ID NO: 32603 - protein, 214 aa, Staphylococcus aureus A8117; identical to SEQ ID NO: 30966

SEQ ID NO: 32604 - protein, 562 aa, Staphylococcus aureus A8117
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIP

SEQ ID NO: 32605 - protein, 938 aa, Staphylococcus aureus A8117; identical to SEQ ID NO: 30838

SEQ ID NO: 32606 - protein, 1038 aa, Staphylococcus aureus A8117; identical to SEQ ID NO: 30590

SEQ ID NO: 32607 - protein, 829 aa, Staphylococcus aureus A8117
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSVLRQRFRFG

SEQ ID NO: 32608 - protein, 51 aa, Staphylococcus aureus A8117; identical to SEQ ID NO: 32222

SEQ ID NO: 32609 - protein, 434 aa, Staphylococcus aureus A8117 [sequence omitted]

SEQ ID NO: 32610 - protein, 655 aa, Staphylococcus aureus A8117
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSAS

SEQ ID NO: 32611 - protein, 259 aa, Staphylococcus aureus A8117; identical to SEQ ID NO: 30226

SEQ ID NO: 32612 - protein, 257 aa, Staphylococcus aureus A8117
MTLTLLITPLVYSDSKNETIKEKNLHKKSELSSITLNNLRHIYFFNEKGISEKIMTEDQFLDYTLLFKSFFISHSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFDGKIQKGLIVFHTSKEPLVSYDLFNVIGQYPDKLLKIYQDNKIIESENMHIDIYLYTSLIVLISLPLVL

SEQ ID NO: 32613 - protein, 129 aa, Staphylococcus aureus A8117
MKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKMLPYKN

SEQ ID NO: 32614 - protein, 51 aa, Staphylococcus aureus A8117
MSTVKDQHKTAKALPETGSENNNSNNGTLFGGLFAALGSLLLFGRRKKQNK

SEQ ID NO: 32615 - protein, 1179 aa, Staphylococcus aureus A8117
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSD

SEQ ID NO: 32616 - protein, 51 aa, Staphylococcus aureus A8117; identical to SEQ ID NO: 32234

SEQ ID NO: 32617 - protein, 1012 aa, Staphylococcus aureus A8117
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDS

SEQ ID NO: 32618 - protein, 141 aa, Staphylococcus aureus A8796; identical to SEQ ID NO: 30633

SEQ ID NO: 32619 - protein, 325 aa, Staphylococcus aureus A8796; identical to SEQ ID NO: 30407

SEQ ID NO: 32620 - protein, 861 aa, Staphylococcus aureus A8796
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32621 - protein, 961 aa, Staphylococcus aureus A8796; identical to SEQ ID NO: 30589

SEQ ID NO: 32622 - protein, 1038 aa, Staphylococcus aureus A8796; identical to SEQ ID NO: 30590

SEQ ID NO: 32623 - protein, 233 aa, Staphylococcus aureus A8796; identical to SEQ ID NO: 30591

SEQ ID NO: 32624 - protein, 214 aa, Staphylococcus aureus A8796; identical to SEQ ID NO: 30966

SEQ ID NO: 32625 - protein, 811 aa, Staphylococcus aureus A8796
MSMTYRMKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 32626 - protein, 309 aa, Staphylococcus aureus A8796; identical to SEQ ID NO: 30406

SEQ ID NO: 32627 - protein, 315 aa, Staphylococcus aureus A8796; identical to SEQ ID NO: 30573

SEQ ID NO: 32628 - protein, 383 aa, Staphylococcus aureus A8796; identical to SEQ ID NO: 31488

SEQ ID NO: 32629 - protein, 241 aa, Staphylococcus aureus A8796; identical to SEQ ID NO: 30571

SEQ ID NO: 32630 - protein, 519 aa, Staphylococcus aureus A8796
MTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32631 - protein, 254 aa, Staphylococcus aureus A8796; identical to SEQ ID NO: 30809

SEQ ID NO: 32632 - protein, 239 aa, Staphylococcus aureus A8796; identical to SEQ ID NO: 30622

SEQ ID NO: 32633 - protein, 242 aa, Staphylococcus aureus A8796; identical to SEQ ID NO: 30399

SEQ ID NO: 32634 - protein, 251 aa, Staphylococcus aureus A8796; identical to SEQ ID NO: 30946

SEQ ID NO: 32635 - protein, 258 aa, Staphylococcus aureus A8796; identical to SEQ ID NO: 30410

SEQ ID NO: 32636 - protein, 311 aa, Staphylococcus aureus A8796; identical to SEQ ID NO: 30617

SEQ ID NO: 32637 - protein, 327 aa, Staphylococcus aureus A8796; identical to SEQ ID NO: 30616

SEQ ID NO: 32638 - protein, 2186 aa, Staphylococcus aureus A8796
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTKEERLAAKHLVEQALNQAIDQINHADKTAQVNQDSIDAQNIISKIKPATTVKTTALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 32639 - protein, 331 aa, Staphylococcus aureus A8796; identical to SEQ ID NO: 30615

SEQ ID NO: 32640 - protein, 891 aa, Staphylococcus aureus A8796; identical to SEQ ID NO: 30788

SEQ ID NO: 32641 - protein, 434 aa, Staphylococcus aureus A8796 [sequence omitted]

SEQ ID NO: 32642 - protein, 905 aa, Staphylococcus aureus A8796; identical to SEQ ID NO: 30600

SEQ ID NO: 32643 - protein, 691 aa, Staphylococcus aureus A8796; identical to SEQ ID NO: 30511

SEQ ID NO: 32644 - protein, 203 aa, Staphylococcus aureus A8796; identical to SEQ ID NO: 30576

SEQ ID NO: 32645 - protein, 226 aa, Staphylococcus aureus A8796; identical to SEQ ID NO: 30577

SEQ ID NO: 32646 - protein, 231 aa, Staphylococcus aureus A8796; identical to SEQ ID NO: 30578

SEQ ID NO: 32647 - protein, 356 aa, Staphylococcus aureus A8796; identical to SEQ ID NO: 30579

SEQ ID NO: 32648 - protein, 297 aa, Staphylococcus aureus A8796
MEHTTMKITTIAKTSLALGLLTTGVITTTTQEANATTPSSTKVEAPQSTPPSTKVEAPQSKPNATTPPSTKVETPQQTPNATTPSSTKVETPQSPTTKQVPTEINPKFKDLRAYYTKPSLEFKNEIGIILKKWTTIRFMNIVPDYFIYKIALVGKDDKKYDEGVHRNVDVFVVLEEKNKYGVERYSVGGITKSNSKKVDHKAGVRITKEDNKGTISHDVSEFKITKEQISLKELDFKLRKQLIENHNLYGNVGSGKIVINMKNGGKYTFELHKKLQENRMADVIDGTNIDNIEVNIK

SEQ ID NO: 32649 - protein, 239 aa, Staphylococcus aureus A8796
MEHTTMKMAAIAKASLALGILATGTITSLHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 32650 - protein, 231 aa, Staphylococcus aureus A8796; identical to SEQ ID NO: 30582

SEQ ID NO: 32651 - protein, 237 aa, Staphylococcus aureus A8796
MEHMNMKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 32652 - protein, 232 aa, Staphylococcus aureus A8796; identical to SEQ ID NO: 30584

SEQ ID NO: 32653 - protein, 227 aa, Staphylococcus aureus A8796; identical to SEQ ID NO: 30585

SEQ ID NO: 32654 - protein, 227 aa, Staphylococcus aureus A8796; identical to SEQ ID NO: 30586

SEQ ID NO: 32655 - protein, 291 aa, Staphylococcus aureus A8796; identical to SEQ ID NO: 30390

SEQ ID NO: 32656 - protein, 763 aa, Staphylococcus aureus A8796
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDYRFR

SEQ ID NO: 32657 - protein, 2271 aa, Staphylococcus aureus A8796; identical to SEQ ID NO: 30597

SEQ ID NO: 32658 - protein, 680 aa, Staphylococcus aureus A8796; identical to SEQ ID NO: 30845

SEQ ID NO: 32659 - protein, 241 aa, Staphylococcus aureus A8796; identical to SEQ ID NO: 30608

SEQ ID NO: 32660 - protein, 241 aa, Staphylococcus aureus A8796; identical to SEQ ID NO: 30607

SEQ ID NO: 32661 - protein, 238 aa, Staphylococcus aureus A8796; identical to SEQ ID NO: 30606

SEQ ID NO: 32662 - protein, 319 aa, Staphylococcus aureus A8796; identical to SEQ ID NO: 30605

SEQ ID NO: 32663 - protein, 231 aa, Staphylococcus aureus A8796; identical to SEQ ID NO: 30630

SEQ ID NO: 32664 - protein, 2481 aa, Staphylococcus aureus A8796; identical to SEQ ID NO: 30631

SEQ ID NO: 32665 - protein, 51 aa, Staphylococcus aureus A8796; identical to SEQ ID NO: 32614

SEQ ID NO: 32666 - protein, 1337 aa, Staphylococcus aureus A8796; identical to SEQ ID NO: 30811

SEQ ID NO: 32667 - protein, 1153 aa, Staphylococcus aureus A8796; identical to SEQ ID NO: 30596

SEQ ID NO: 32668 - protein, 848 aa, Staphylococcus aureus A8796
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDS

SEQ ID NO: 32669 - protein, 96 aa, Staphylococcus aureus A8796; identical to SEQ ID NO: 30813

SEQ ID NO: 32670 - protein, 274 aa, Staphylococcus aureus A8796; identical to SEQ ID NO: 30815

SEQ ID NO: 32671 - protein, 338 aa, Staphylococcus aureus A8796; identical to SEQ ID NO: 30627

SEQ ID NO: 32672 - protein, 351 aa, Staphylococcus aureus A8796; identical to SEQ ID NO: 30628

SEQ ID NO: 32673 - protein, 645 aa, Staphylococcus aureus A8796; identical to SEQ ID NO: 30601

SEQ ID NO: 32674 - protein, 350 aa, Staphylococcus aureus A8796; identical to SEQ ID NO: 30602

SEQ ID NO: 32675 - protein, 109 aa, Staphylococcus aureus A8796; identical to SEQ ID NO: 30603

SEQ ID NO: 32676 - protein, 165 aa, Staphylococcus aureus A8796; identical to SEQ ID NO: 30418

SEQ ID NO: 32677 - protein, 169 aa, Staphylococcus aureus A8796
DSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32678 - protein, 811 aa, Staphylococcus aureus A8819; identical to SEQ ID NO: 32625

SEQ ID NO: 32679 - protein, 141 aa, Staphylococcus aureus A8819; identical to SEQ ID NO: 30633

SEQ ID NO: 32680 - protein, 309 aa, Staphylococcus aureus A8819; identical to SEQ ID NO: 30406

SEQ ID NO: 32681 - protein, 315 aa, Staphylococcus aureus A8819; identical to SEQ ID NO: 30573

SEQ ID NO: 32682 - protein, 325 aa, Staphylococcus aureus A8819; identical to SEQ ID NO: 30407

SEQ ID NO: 32683 - protein, 861 aa, Staphylococcus aureus A8819; identical to SEQ ID NO: 32620

SEQ ID NO: 32684 - protein, 961 aa, Staphylococcus aureus A8819; identical to SEQ ID NO: 30589

SEQ ID NO: 32685 - protein, 1038 aa, Staphylococcus aureus A8819; identical to SEQ ID NO: 30590

SEQ ID NO: 32686 - protein, 233 aa, Staphylococcus aureus A8819; identical to SEQ ID NO: 30591

SEQ ID NO: 32687 - protein, 214 aa, Staphylococcus aureus A8819; identical to SEQ ID NO: 30966

SEQ ID NO: 32688 - protein, 519 aa, Staphylococcus aureus A8819; identical to SEQ ID NO: 32630

SEQ ID NO: 32689 - protein, 241 aa, Staphylococcus aureus A8819; identical to SEQ ID NO: 30571

SEQ ID NO: 32690 - protein, 691 aa, Staphylococcus aureus A8819; identical to SEQ ID NO: 30511

SEQ ID NO: 32691 - protein, 203 aa, Staphylococcus aureus A8819; identical to SEQ ID NO: 30576

SEQ ID NO: 32692 - protein, 226 aa, Staphylococcus aureus A8819; identical to SEQ ID NO: 30577

SEQ ID NO: 32693 - protein, 231 aa, Staphylococcus aureus A8819; identical to SEQ ID NO: 30578

SEQ ID NO: 32694 - protein, 356 aa, Staphylococcus aureus A8819; identical to SEQ ID NO: 30579

SEQ ID NO: 32695 - protein, 297 aa, Staphylococcus aureus A8819; identical to SEQ ID NO: 32648

SEQ ID NO: 32696 - protein, 239 aa, Staphylococcus aureus A8819; identical to SEQ ID NO: 32649

SEQ ID NO: 32697 - protein, 231 aa, Staphylococcus aureus A8819; identical to SEQ ID NO: 30582

SEQ ID NO: 32698 - protein, 237 aa, Staphylococcus aureus A8819; identical to SEQ ID NO: 32651

SEQ ID NO: 32699 - protein, 232 aa, Staphylococcus aureus A8819; identical to SEQ ID NO: 30584

SEQ ID NO: 32700 - protein, 227 aa, Staphylococcus aureus A8819; identical to SEQ ID NO: 30585

SEQ ID NO: 32701 - protein, 227 aa, Staphylococcus aureus A8819; identical to SEQ ID NO: 30586

SEQ ID NO: 32702 - protein, 645 aa, Staphylococcus aureus A8819; identical to SEQ ID NO: 30601

SEQ ID NO: 32703 - protein, 350 aa, Staphylococcus aureus A8819; identical to SEQ ID NO: 30602

SEQ ID NO: 32704 - protein, 109 aa, Staphylococcus aureus A8819; identical to SEQ ID NO: 30603

SEQ ID NO: 32705 - protein, 165 aa, Staphylococcus aureus A8819; identical to SEQ ID NO: 30418

SEQ ID NO: 32706 - protein, 891 aa, Staphylococcus aureus A8819; identical to SEQ ID NO: 30788

SEQ ID NO: 32707 - protein, 2186 aa, Staphylococcus aureus A8819; identical to SEQ ID NO: 30789

SEQ ID NO: 32708 - protein, 331 aa, Staphylococcus aureus A8819; identical to SEQ ID NO: 30615

SEQ ID NO: 32709 - protein, 327 aa, Staphylococcus aureus A8819; identical to SEQ ID NO: 30616

SEQ ID NO: 32710 - protein, 311 aa, Staphylococcus aureus A8819; identical to SEQ ID NO: 30617

SEQ ID NO: 32711 - protein, 258 aa, Staphylococcus aureus A8819; identical to SEQ ID NO: 30410

SEQ ID NO: 32712 - protein, 251 aa, Staphylococcus aureus A8819; identical to SEQ ID NO: 30946

SEQ ID NO: 32713 - protein, 242 aa, Staphylococcus aureus A8819; identical to SEQ ID NO: 30399

SEQ ID NO: 32714 - protein, 239 aa, Staphylococcus aureus A8819; identical to SEQ ID NO: 30622

SEQ ID NO: 32715 - protein, 254 aa, Staphylococcus aureus A8819; identical to SEQ ID NO: 30809

SEQ ID NO: 32716 - protein, 383 aa, Staphylococcus aureus A8819; identical to SEQ ID NO: 31488

SEQ ID NO: 32717 - protein, 434 aa, Staphylococcus aureus A8819 [sequence omitted]

SEQ ID NO: 32718 - protein, 905 aa, Staphylococcus aureus A8819; identical to SEQ ID NO: 30600

SEQ ID NO: 32719 - protein, 291 aa, Staphylococcus aureus A8819; identical to SEQ ID NO: 30390

SEQ ID NO: 32720 - protein, 877 aa, Staphylococcus aureus A8819; identical to SEQ ID NO: 30593

SEQ ID NO: 32721 - protein, 2271 aa, Staphylococcus aureus A8819; identical to SEQ ID NO: 30597

SEQ ID NO: 32722 - protein, 680 aa, Staphylococcus aureus A8819; identical to SEQ ID NO: 30845

SEQ ID NO: 32723 - protein, 965 aa, Staphylococcus aureus A8819; identical to SEQ ID NO: 30920

SEQ ID NO: 32724 - protein, 1337 aa, Staphylococcus aureus A8819; identical to SEQ ID NO: 30811

SEQ ID NO: 32725 - protein, 1153 aa, Staphylococcus aureus A8819; identical to SEQ ID NO: 30596

SEQ ID NO: 32726 - protein, 231 aa, Staphylococcus aureus A8819; identical to SEQ ID NO: 30630

SEQ ID NO: 32727 - protein, 2481 aa, Staphylococcus aureus A8819; identical to SEQ ID NO: 30631

SEQ ID NO: 32728 - protein, 319 aa, Staphylococcus aureus A8819; identical to SEQ ID NO: 30605

SEQ ID NO: 32729 - protein, 238 aa, Staphylococcus aureus A8819; identical to SEQ ID NO: 30606

SEQ ID NO: 32730 - protein, 241 aa, Staphylococcus aureus A8819; identical to SEQ ID NO: 30607

SEQ ID NO: 32731 - protein, 241 aa, Staphylococcus aureus A8819; identical to SEQ ID NO: 30608

SEQ ID NO: 32732 - protein, 274 aa, Staphylococcus aureus A8819; identical to SEQ ID NO: 30815

SEQ ID NO: 32733 - protein, 338 aa, Staphylococcus aureus A8819; identical to SEQ ID NO: 30627

SEQ ID NO: 32734 - protein, 351 aa, Staphylococcus aureus A8819; identical to SEQ ID NO: 30628

SEQ ID NO: 32735 - protein, 96 aa, Staphylococcus aureus A8819; identical to SEQ ID NO: 30813

SEQ ID NO: 32736 - protein, 258 aa, Staphylococcus aureus A8819; identical to SEQ ID NO: 30228

SEQ ID NO: 32737 - protein, 268 aa, Staphylococcus aureus A8819; identical to SEQ ID NO: 30398

SEQ ID NO: 32738 - protein, 259 aa, Staphylococcus aureus A8819; identical to SEQ ID NO: 30226

SEQ ID NO: 32739 - protein, 214 aa, Staphylococcus aureus A9299; identical to SEQ ID NO: 30966

SEQ ID NO: 32740 - protein, 773 aa, Staphylococcus aureus A9299
MHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEHGGN

SEQ ID NO: 32741 - protein, 233 aa, Staphylococcus aureus A9299; identical to SEQ ID NO: 30591

SEQ ID NO: 32742 - protein, 260 aa, Staphylococcus aureus A9299; identical to SEQ ID NO: 30625

SEQ ID NO: 32743 - protein, 96 aa, Staphylococcus aureus A9299; identical to SEQ ID NO: 30813

SEQ ID NO: 32744 - protein, 140 aa, Staphylococcus aureus A9299; identical to SEQ ID NO: 32317

SEQ ID NO: 32745 - protein, 645 aa, Staphylococcus aureus A9299; identical to SEQ ID NO: 30601

SEQ ID NO: 32746 - protein, 350 aa, Staphylococcus aureus A9299; identical to SEQ ID NO: 30602

SEQ ID NO: 32747 - protein, 109 aa, Staphylococcus aureus A9299; identical to SEQ ID NO: 30603

SEQ ID NO: 32748 - protein, 165 aa, Staphylococcus aureus A9299; identical to SEQ ID NO: 30418

SEQ ID NO: 32749 - protein, 231 aa, Staphylococcus aureus A9299; identical to SEQ ID NO: 30630

SEQ ID NO: 32750 - protein, 351 aa, Staphylococcus aureus A9299; identical to SEQ ID NO: 30628

SEQ ID NO: 32751 - protein, 338 aa, Staphylococcus aureus A9299; identical to SEQ ID NO: 30627

SEQ ID NO: 32752 - protein, 274 aa, Staphylococcus aureus A9299; identical to SEQ ID NO: 30872

SEQ ID NO: 32753 - protein, 227 aa, Staphylococcus aureus A9299; identical to SEQ ID NO: 30586

SEQ ID NO: 32754 - protein, 227 aa, Staphylococcus aureus A9299; identical to SEQ ID NO: 30585

SEQ ID NO: 32755 - protein, 232 aa, Staphylococcus aureus A9299; identical to SEQ ID NO: 30584

SEQ ID NO: 32756 - protein, 234 aa, Staphylococcus aureus A9299; identical to SEQ ID NO: 32190

SEQ ID NO: 32757 - protein, 229 aa, Staphylococcus aureus A9299
MKLKTLAKATLALGLLTTGVITSEGQAVHAKEKQERVQHLYDIKDLYRYYSSESFEFSNISGKVENYNGSNVVRFNQEKQNHQLFLLGKDKYKKGLEGQNVFVVKELIDPNGRLSTVGGVTKKNNKSSETNTHLFVNKVYGGNLDASIDSFLINKEEVSLKELDFKIRKQLVEKYGLYKGTTKYGKITINLKDEKKEVIDLGDKLQFERMGDVLNSKDIQNIAVTINQI

SEQ ID NO: 32758 - protein, 234 aa, Staphylococcus aureus A9299; identical to SEQ ID NO: 30581

SEQ ID NO: 32759 - protein, 251 aa, Staphylococcus aureus A9299
MEHTTMKITTIAKTSLALGLLTTGVITTTTQEANATTPSSTKVETPQSPTTKQVPTEINPKFKDLRAYYTKPSLEFKNEIGIILKKWTTIRFMNIVPDYFIYKIALVGKDDKKYDEGVHRNVDVFVVLEEKNKYGVERYSVGGITKSNSKKVDHKAGVRITKEDNKGTISHDVSEFKITKEQISLKELDFKLRKQLIENHNLYGNVGSGKIVINMKNGGKYTFELHKKLQENRMADVIDGTNIDNIEVNIK

SEQ ID NO: 32760 - protein, 356 aa, Staphylococcus aureus A9299; identical to SEQ ID NO: 30793

SEQ ID NO: 32761 - protein, 231 aa, Staphylococcus aureus A9299; identical to SEQ ID NO: 30578

SEQ ID NO: 32762 - protein, 226 aa, Staphylococcus aureus A9299; identical to SEQ ID NO: 30577

SEQ ID NO: 32763 - protein, 203 aa, Staphylococcus aureus A9299; identical to SEQ ID NO: 30576

SEQ ID NO: 32764 - protein, 122 aa, Staphylococcus aureus A9299; identical to SEQ ID NO: 32202

SEQ ID NO: 32765 - protein, 1099 aa, Staphylococcus aureus A9299
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 32766 - protein, 1385 aa, Staphylococcus aureus A9299; identical to SEQ ID NO: 30595

SEQ ID NO: 32767 - protein, 112 aa, Staphylococcus aureus A9299
SDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32768 - protein, 331 aa, Staphylococcus aureus A9299; identical to SEQ ID NO: 30615

SEQ ID NO: 32769 - protein, 327 aa, Staphylococcus aureus A9299; identical to SEQ ID NO: 30616

SEQ ID NO: 32770 - protein, 311 aa, Staphylococcus aureus A9299; identical to SEQ ID NO: 30617

SEQ ID NO: 32771 - protein, 258 aa, Staphylococcus aureus A9299; identical to SEQ ID NO: 30410

SEQ ID NO: 32772 - protein, 251 aa, Staphylococcus aureus A9299; identical to SEQ ID NO: 30946

SEQ ID NO: 32773 - protein, 131 aa, Staphylococcus aureus A9299; identical to SEQ ID NO: 30867

SEQ ID NO: 32774 - protein, 242 aa, Staphylococcus aureus A9299; identical to SEQ ID NO: 30399

SEQ ID NO: 32775 - protein, 239 aa, Staphylococcus aureus A9299; identical to SEQ ID NO: 30622

SEQ ID NO: 32776 - protein, 254 aa, Staphylococcus aureus A9299; identical to SEQ ID NO: 30809

SEQ ID NO: 32777 - protein, 291 aa, Staphylococcus aureus A9299; identical to SEQ ID NO: 30390

SEQ ID NO: 32778 - protein, 891 aa, Staphylococcus aureus A9299; identical to SEQ ID NO: 30788

SEQ ID NO: 32779 - protein, 2186 aa, Staphylococcus aureus A9299; identical to SEQ ID NO: 30516

SEQ ID NO: 32780 - protein, 599 aa, Staphylococcus aureus A9299
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSG

SEQ ID NO: 32781 - protein, 2271 aa, Staphylococcus aureus A9299; identical to SEQ ID NO: 30597

SEQ ID NO: 32782 - protein, 681 aa, Staphylococcus aureus A9299; identical to SEQ ID NO: 30598

SEQ ID NO: 32783 - protein, 488 aa, Staphylococcus aureus A9299
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32784 - protein, 241 aa, Staphylococcus aureus A9299; identical to SEQ ID NO: 30571

SEQ ID NO: 32785 - protein, 241 aa, Staphylococcus aureus A9299; identical to SEQ ID NO: 30608

SEQ ID NO: 32786 - protein, 241 aa, Staphylococcus aureus A9299; identical to SEQ ID NO: 30607

SEQ ID NO: 32787 - protein, 238 aa, Staphylococcus aureus A9299; identical to SEQ ID NO: 30606

SEQ ID NO: 32788 - protein, 319 aa, Staphylococcus aureus A9299; identical to SEQ ID NO: 30605

SEQ ID NO: 32789 - protein, 2481 aa, Staphylococcus aureus A9299
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTITTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 32790 - protein, 691 aa, Staphylococcus aureus A9299; identical to SEQ ID NO: 30511

SEQ ID NO: 32791 - protein, 434 aa, Staphylococcus aureus A9299 [sequence omitted]

SEQ ID NO: 32792 - protein, 989 aa, Staphylococcus aureus A9299; identical to SEQ ID NO: 31697

SEQ ID NO: 32793 - protein, 847 aa, Staphylococcus aureus A9299
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSD

SEQ ID NO: 32794 - protein, 357 aa, Staphylococcus aureus A9299
TPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32795 - protein, 325 aa, Staphylococcus aureus A9299; identical to SEQ ID NO: 30407

SEQ ID NO: 32796 - protein, 315 aa, Staphylococcus aureus A9299; identical to SEQ ID NO: 30573

SEQ ID NO: 32797 - protein, 321 aa, Staphylococcus aureus A9299; identical to SEQ ID NO: 30959

SEQ ID NO: 32798 - protein, 141 aa, Staphylococcus aureus A9299; identical to SEQ ID NO: 30633

SEQ ID NO: 32799 - protein, 809 aa, Staphylococcus aureus A9299; identical to SEQ ID NO: 30632

SEQ ID NO: 32800 - protein, 467 aa, Staphylococcus aureus A9299
MQMRDKKGPVNKRVDFLSNKLNKYSIRKFTVGTASILIGSLMYLGTQQEAEAAENNIENPTTLKDNVQSKEVKIEEVTNKDTAPQGVESKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITT

SEQ ID NO: 32801 - protein, 69 aa, Staphylococcus aureus A9299
MEQGKVVTPVIEINEKVKAVAPTKQKQSKKSELPETGGEESTNKGMLFGGLFSILGLVLLRRNKKNNKA

SEQ ID NO: 32802 - protein, 762 aa, Staphylococcus aureus A9299
MHLRENIIVKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGN

SEQ ID NO: 32803 - protein, 105 aa, Staphylococcus aureus A9299
MPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 32804 - protein, 768 aa, Staphylococcus aureus A9635
MNNKKTAINRKGMIPNRLNKFSIRKYSVGTASILVGTTLIFGLSGHEAKAAEHTNGELNQSKNETTDSSENKTTEKVDSRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDADNWTLDSGFYKTPKYSLGDYVWYDSNKDGKQDSTEKGIKGVKVTLQNEKGEVIGTTETDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDSDSDSDSDSD

SEQ ID NO: 32805 - protein, 808 aa, Staphylococcus aureus A9635
MSMTYRMKKWQKLSTITLLMAGVITLSDGEFRSVDKHQIAVADTNTQTPNYEKLKNTWLDVNYGYDKYDESNPDMKKKFEATENEAKKLLSEMKTESGRTYLWESSKDIDTKSADMTRTYRNIEKIAEAMNHPKTTLKNDENKKKLKDALEWLHKNAYGKDPDKKVADLKTNFSKSAPQKNTNLNWWDYEIGTPKSLTNTLILLNGDISSDEKKKYTAPIKTFAPKSDEILSSVGKAEPAKGGNLVDIAKVKLLESIIEEDKDMTKNSIDSFNKVFTYVQSNSTGKERNGFYKDGSYIDHQDVPYTGAYGVVLLEGISQMMPMIKETPFKETSQNDTILKSWIDDGFMPLIYKGEMMDLSRGRAISRENETSHSASVTVMKSLLRLSDAMDESTKAKYKKIVKTSVKSDSSYKQNDYLSSYSDISKMKALMEDSTLSTNDLTQQLKIYNDMDRVTYHNKDLDFAFGLSMTSKNVARYESINNENLKGWHTGAGMSYLYNSDVKHYRDNFWATADMKRLAGTTTLDNEEPKENKNSDKTFVGGTKFDDQHASIGMEFENQDKTLTAKKSYFILNDKIVFLGTGIKNTDSSMNPVTTIENRKANGYTLYTDDKQTTNSDNQETNSVFLESTDTKKNIGYHFLNKSKINVKKESHTGKWSEINKSQKTEDKKDEYYEVTQKHSNSDNKYGYVLYPSLSKDVFKSKASQVTVVKQDDDFHVVKDNESVWAGVNYSDSAKTFEINGTKVEVKAKGMFILKKKDDKTYECSFYNPESTNTASDIESKISMTGYSITNKNASTTNESGVRFELTK

SEQ ID NO: 32806 - protein, 141 aa, Staphylococcus aureus A9635
MKLKSFVTATLALGLLSTVGAALPSHEASADSNNGYKEMTMDGYHTVPYTISVDGITALHRTYFVFPENKKVLYQEIDSKVKNELASQRGVTTEKINNAQTATYTLTLNDGNKKVVNLKKNDDAKNLIDPSTIKQIQIVVK

SEQ ID NO: 32807 - protein, 331 aa, Staphylococcus aureus A9635
MSNQFKSEEERRQWEQFQAFQNQQNQQYQQYGQKKSKKGWFWGCGGCLVLFILIIIGISACTAGITGNLGGNSSKETNKTHKIGETVKNGDLEVTVNSVETMKSVGPSIAPTNAKGTFVVADVTIKNKGKEALTIDSSMFKLKSGDKTFEADNTGSMSANQNDNGSIENSFFLQRINPDSTAQGKIVFDVSENIANAKDKKLEVISSLFSVKKITFDLSDAKKTSKAKKDKQDTEVAVTSSNSDNVNYEASATTPATTSSADTDSEDSEKSSKDEDKQNASKSDKSSVEKSESNEETAPVEPMPHSKPTTSEAPPSQNIHNENSMYDASTE

SEQ ID NO: 32808 - protein, 1165 aa, Staphylococcus aureus A9635
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPLGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLIQTGTNTTEDDKDADGGEVDVTITDHDDFTIDNGYFEEDTSDSDSDSDSDSDSDSDSDSDSDSDSDSDSDSDSDSDSDSDSDSDSDSDSDS

SEQ ID NO: 32809 - protein, 192 aa, Staphylococcus aureus A9635
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNAGKHTPAKPMSAVKDHNNKAKALPETGTENNNSNNGTLFGGLFAALGSLLLFGRRKKQNK

SEQ ID NO: 32810 - protein, 45 aa, Staphylococcus aureus A9635; identical to SEQ ID NO: 31097

SEQ ID NO: 32811 - protein, 351 aa, Staphylococcus aureus A9635
MKNKKRVFIASSLSCALLLLSAANTEANSANKDSQDQTKKEHVDKAQQKEKRNVNDKDKNTPGPDDIGKNGKVTKRTVSEYDKETNILQNLQFDFIDDPTYDKNVLLVKKQGSIHSNLKFESHRNETNASWLKYPSEYHVDFQVQRNPKTEILDQLPKNKISTAKVDSTFSYSLGGKFDSTKGIGRTSSNSYSKSISYNQQNYDTIASGKNNNRHVHWSVVANDLKYGNEIKNRNDEFLFYRNTRLSTVENPELSFASKYRYPALVRSGFNPEFLTYISNEKTNDKTRFEVTYTRNQDILKNKPGIHYGQPILEQNKDGQRFIVVYEVDWKNKTVKVVEKYSDQNKPYKEG

SEQ ID NO: 32812 - protein, 339 aa, Staphylococcus aureus A9635
MIKQVCKNITICSLALSTALTVFPASSYAEIKSKITTVSEKNLDGDTKMYTRTATTSDTEKKISQSLQFNFLTEPNYDKETVFIKAKGTIGSGLKILNPNGYWNSTLRWPGSYSVSIQNVDDNNNSTNVTDFAPKNQDESREVKYTYGYKTGGDFSINRGGLTGNITKEKNYSETISYQQPSYRTLIDQPTTNKGVAWKVEAHSINNMGHDHTRQLTNDSDDRVKSEIFSLTRNGNLWAKDNFTPKNKMPVTVSEGFNPEFLAVMSHDKNDKGKSRFIVHYKRSMDDFKLDWNKHGFWGYWSGENHVDQKEEKLSALYEVDWKTHDVKLIKTFNDKEKK

SEQ ID NO: 32813 - protein, 274 aa, Staphylococcus aureus A9635; identical to SEQ ID NO: 30872

SEQ ID NO: 32814 - protein, 2459 aa, Staphylococcus aureus A9635
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAAGTTQPAAGTTQPAGQGNQADPNNAVQAQPGNQAAPANQAGQGNNQATPNNAAPANQTQPANAPAAAQPAAPVAANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKAMQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 32815 - protein, 231 aa, Staphylococcus aureus A9635
MKKTLLASSLAVGLGIVAGNAGHEAHASESDLNKASLAQMAQSNDQTLNQKPIEAGAYNYTFDYEGFTYHFESDGTYFAWNYHATGANGADMSAQAPATNNVAPSADQANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 32816 - protein, 689 aa, Staphylococcus aureus A9635
MKFKSLITTTLALGVIASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKVNNQVPYSINLNGTTTNIQSNLAFSNKPWTNYKNLTTKVKSVLKSDRGVSERDLKHAKKAYYTVYFKNGGKRVIHLNSNIYTANLVHAKDVKRIEVTVKTVSKVKAERYVPYTIAVNGASNPTLSDLKFTGDSRVSYSDITKKVKSVLKHDRGIGERELKYAKKATYTVHFKNGTKKVINLNSNISQLNLLYVKDIKNIDIDVKTGAKAKADSYVPYTIAVNGTTTPIASKLKLSNKQLIGYQDLNKKVKSVLKHDRGINDIELKFAKQAKYTIHFKNGKTQVVDLKSDIFTRNLFSVKDIKKIDINVKQHTKSNKALNKVTNKATKVKFPVTINGFSNLVSNEFAFLHPHKITTNDLNAKLRLALASDQGITKHDIGLSERTVYKVYFKDGSSKFVDLKAAKQDSKVFKATDIKKVDIEIKF

SEQ ID NO: 32817 - protein, 94 aa, Staphylococcus aureus A9635
SDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 32818 - protein, 258 aa, Staphylococcus aureus A9635; identical to SEQ ID NO: 30410

SEQ ID NO: 32819 - protein, 251 aa, Staphylococcus aureus A9635; identical to SEQ ID NO: 30946

SEQ ID NO: 32820 - protein, 256 aa, Staphylococcus aureus A9635
MKLFAFIFICVKSCSLLFMLNGNPKPEQLNKASEFTGLMDNMRYLYDDKHVSETNIKSQEKFLQHDLLFKINGSKILKTEFNNKSLSDKYKNKNVDLFGTNYYNQCYFSSDNMELNDGRLIEKKCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 32821 - protein, 242 aa, Staphylococcus aureus A9635
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMFGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 32822 - protein, 239 aa, Staphylococcus aureus A9635
MKRILIIVVLLFCYSQNHIATADVGVLNLRNYYGSYPIEDHQSINPENNHLSHQLVFSMDNSTITAEFKNVDDVKKFKNHAVDVYGLSYSGYCLKNKYIYGGVTLAGDYLEKSRCIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 32823 - protein, 254 aa, Staphylococcus aureus A9635
MLNVLLLILNLIAICSVNNAYANEEDPKIESLCKKSSVDPIALHNINDDYINNRFTTVKSIVSTTEKFLDFDLLFKSIDWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 32824 - protein, 532 aa, Staphylococcus aureus A9635
MNKNVLKFMVFIMLLNIITPLFNKNEAFAARDISSTNVTDLTVSTSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGQSAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKAIKYLVKEVNAQGEDTTPEGYTKKENGLVVTNTEKPI

SEQ ID NO: 32825 - protein, 434 aa, Staphylococcus aureus A9635 [sequence omitted]

SEQ ID NO: 32826 - protein, 973 aa, Staphylococcus aureus A9635
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSTSDSDSASDSDSASDSDSDSDSDSNSDSDSDSDSDSDSDSDSDIDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSDSDSDSDSDSDSDSDSDSDLASDSDSASDSDSASDSDSDSDSDSDSDSDSNSDSDSDSDSDSDSDSDSDSDSDSDSDSDSDSDSDSDNDSDSDSDSDSASDSDSGSDSDSSSDSDSDSDSDSASDSDSDSTSDTGSDNDSDSSSDSDSDSDSDSDSDSESGSNNNVVPPNSPKNGTNASNKNEAKDSKEPLPDTGSEDEANTSLIWGFLASLGSLLLFRRKKENKDKN

SEQ ID NO: 32827 - protein, 241 aa, Staphylococcus aureus A9635
MKKNIMNKLVLSTALLLLGTTSTQLPKTPISFSSEAKAYNISENETNINELIKYYTQPHLSLSGKWLWQKPNGTIHATLQTWVWYTHIQVFGPESWGNINQLRDKYVDIFGTKDEDTVEGYWTYDETFTGGVTPAATSSDKHYKLSLKYRDKLQTMIGGLEFYQGNKPVITLKELDFRVRQTLIKNKKLYNGEFNKGQIKITGGGNNYTIDLSKKLKLTDTNRYVKNPRNTEIEVILEKSR

SEQ ID NO: 32828 - protein, 241 aa, Staphylococcus aureus A9635
MKNNLTKKIILSIALTMIGTATIQSPHSPISMSSNAKAYYIDQEETNVSELTKYYTQRHLTFSNKWLWQKENGTIHATLLQLSWFSHIQVFGPESWGNINQLRNKYVDIFALKDYETWHTYMLAQETFTGGVTPAAKPSDKHYKLNLTYKDKSGTFIGEHPFYTGNKPVLTLKEVDFRIRQTLIKNKKLYHGNYNKGHIKITGGSNNYTIDLNKRLKSTDANRYVKNPQTAHIEILLEKSN

SEQ ID NO: 32829 - protein, 238 aa, Staphylococcus aureus A9635
MRKSNIKKLILMTTLLLLGTTATQIPNSPLNVSTDAKAYYIDQNETNINELIKYYTQKPLTFSNRWLYQYDDGNIYVEFKRYSWSAHIRLWGAESWGNINQLRDRYVDVFGLKDEDTSQLWWVYRDTFTGGVTPAASSSDKPYSLFVQYKDKLQTIIGAHKMYQGNKPILTLKEIDFRAREALIKNKILYHENRNKGKLKITGGGNDYTIDLSKRLHSDLANVYVKNPQKITVEVLID

SEQ ID NO: 32830 - protein, 319 aa, Staphylococcus aureus A9635
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKATKQQTNIDVIYERVRDDYQLHWTSTNWKGTNTKDKWTDRSSERYKIDWEKEEMTN

SEQ ID NO: 32831 - protein, 165 aa, Staphylococcus aureus A9635
MKNKLIAKSLLGIAVIGMTATTLASTADASEGYGPREKKPVSINHNIVEYNDGTFKYQSRPKFNTTPQYIKFRHDYNIVEYNDGTFGYGPRPHFNKPAEKSDATIKKEQKLIQAQNLVKEFEKTHTVSAHRKAQKAVNLVSFEYNVKKMILQERIDQVLKQGLVR

SEQ ID NO: 32832 - protein, 109 aa, Staphylococcus aureus A9635; identical to SEQ ID NO: 30603

SEQ ID NO: 32833 - protein, 350 aa, Staphylococcus aureus A9635
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNVNNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKAENTQTTKVVSTEATKDQSQTHSARTVKTTQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 32834 - protein, 644 aa, Staphylococcus aureus A9635
MNKQQKEFKSFYSIRKSSLGVASVAISTLLLLMSNGEAKAAEETGGTITETQPKTEAVASPTTTTEKAPEAKPVANAVSVSNKEVVAPTTETKEAKEVKEVKAPNETKEVKPAAKSDNNTYPILNEELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGERVRTISKDAKNNTRTIIFPYVEGKTLYDAIVKVHVKTIDYDGQYHVRIVDKEAFTKANADKSNKKEQQDNSAKKETTPATPSKPTTAPVEKESQKQDSQKDDNKQSPSVEKEIDASSESGKDKTPATKPAKGEVESSSTTPTKVVSATQNVAKPTSASSETTKGVVQTSAGSSEAKDNAPLQKANIKNTNDGHTQSQNNKNTQENKAKSLPQTGEESNKDMTLPLMALLALSSIIAFVLPRKRKN

SEQ ID NO: 32835 - protein, 388 aa, Staphylococcus aureus A9635
MHYDIIFIYYCKECFIMNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVVNNNEPTKEIKIANLEAQNSNQKKVNKGTNNYFSYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 32836 - protein, 176 aa, Staphylococcus aureus A9635
SDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSESDSDSDTGKHTPVKPMSTTKDHHNKAKALPETGSENNGSNNATLFGGLFAALGSLLLFGRRKKQNK

SEQ ID NO: 32837 - protein, 250 aa, Staphylococcus aureus A9635
MGEFEVKYLTGFILILLLEGIFTNSASAIEYSDLHHKSKLDSKRLYNAKVSFANPTDLENKKTNDRLLKHDLLFHDMFVNDDWKKDFKVEFENEALSKKFINKDIDIFAGNYGYGCHGGETNKTQCSYGGVTLSDNNKYDNDKNIPCNLWIDGHQTEIELTAVKTKKKIVTIQELDVQLRNYLNEKYKLYEQGGDIVKGYVKYHNDDEKNVEYDFYNLNGEYGHEVLKMYADNKTINSDKLHLDIYLFKS

SEQ ID NO: 32838 - protein, 291 aa, Staphylococcus aureus A9635; identical to SEQ ID NO: 30390

SEQ ID NO: 32839 - protein, 891 aa, Staphylococcus aureus A9635
MNKHHPKLRSFYSIRKSTLGVASVIVSTLFLITSQHQAQAAENTNTSDKISENQNNNATTTQPPKDTNQTQPATQPANTAKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVVTNDQSSSNASNQTNTNTSNQNTSTTNNANDQSQATTNMSQPAQPKSSANADQASSQPAHETNSNGNNSDASNTSSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENFHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYVPDKSVYNAIVKVVVANIGYEGQYHVRIVNQDIKTKDDDTSQNNTSEPLNVQTGQENKVSATDTAENSSTATNPKDASDKADVIEPESDMVKDADSSVDKDVQHDVDHLSDMSDNNHFDKYDLKEMDTQIAKDTNKGVDNSVGMISNNHIDKDINKNEGKVIQLAHNADKNNHTGKAAKLDVVKQNYNNKSEVAGNRSTEHPSSDIHKTVDKTVKTKEKASTPSKENKLGQSKMLPKTGETTSSQSWWGLYALLGMLALFIPKFRKESK

SEQ ID NO: 32840 - protein, 2185 aa, Staphylococcus aureus A9635
MNLLKKNKYSIRKYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLAANNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAILGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNDMNVTYDATNRVITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSATGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQNIDNTTQDAAVNDVRNQTIKAIEQIKPKVRRKRAALDNIDESNNNQLAAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEATDEEQNAAIAQVEQALIKAKQHIASAVTNADVAYLLHDGKNEIREIEPVINRKASAREQLTTLLNDKKQAIEANVQATVEERNSVLAQLQNIYDAAIGQLDHDRSNAQVDKTASFNLQTIQGLDVHPVKKPEAEKTINQDIARVTHLVQNYRKVSDRNKADALKAITALKLQMDEELKTARTNADVDAVLKRFNVALGDIEAVITEKEHSLMRIENIAQQTYAKFKAIATPEQLAKVKALIDQYVADGNRMIDEDATLNDIKQHTQFIIDEILAIKLPAEVIKASPKVGQPAPKVCTPIKKEDKQEVRKVEKELPNTGSEEMDLPLKELALITGAALLARRRTKNEKES

SEQ ID NO: 32841 - protein, 520 aa, Staphylococcus aureus A9635
MQYIIRYIMMTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDGNKPGKEDNKKPGKEDGNKPGKEDNNKPGKEDNNKPGKEDGNKPGKEDNKKPGKEDGNKPGKEDNKKPGKEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 32842 - protein, 241 aa, Staphylococcus aureus A9635
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSQMVQNKTGHMSQQDHMNQNTHMNQQPHMQQGHMQSSNHQMMSPKANMHPSNHQMNQSNKKVLPAAGESMTSSILTASVATLLLVSGLFLAFRRRSTNK

SEQ ID NO: 32843 - protein, 231 aa, Staphylococcus aureus A9635
MKLKNIAKASLALGILTTGMITTTAQPVKAESMDSSLTAISNDTQKLKDYYTGTSFDYKNLKGYREGNIATFIFNSQQIDVNLTENEKNKFEDGNGIQNVDVFVVREGSGRQATDYSIGGISKTNGENYKDYVNRPHIEVKRERGMFTTVKSDTDFYINKEEISLKELDFKLRKHLIDKHDLYKTEPKDSKIRVTMKNGDFYTFELNKKLQTHRMGDVIDGRKIEKIEVNL

SEQ ID NO: 32844 - protein, 227 aa, Staphylococcus aureus A9635
MKLTVLAKATLALGILTTGTLTTEAHSGHAKQIHKSVNKHDKEALHRYYSGNFKEMKNINALKHGKNNLRFKYRGMKTQVLLPGDEYRKYQQRRHTGLDVFFVQERRDKHDISYTVGGVTKTNKTSGFVSTPRLNVIKENGEDAFVRGYPYDIKKEEISLKELDFKLRKHLIEKYGLYKTISKHGSVKINMKDGSFYNLNLRCKLAFKYMGEVIESKQIKDIEVNLK

SEQ ID NO: 32845 - protein, 232 aa, Staphylococcus aureus A9635
MKLKTLAKATLALGLLTTGVMTAESQTVHAKVKLDETQRQYYINMLKDYYSQESYESTNISVKSEDYYGSNVLNFNQRNKNFKVFLIGDDRNKYKELMHGRDVFAVPELIDTKGGIYTVGGITKKNVRSVFGYVSHPGLQVKKVDPKDGFSIKELFFIQKEEVSLKELDFKIRKMLVEKYRLYKGASDKGRIVINMKDEKKHEIDLSEKLSFDRMFDVIDSKQIKNIEVNLN

SEQ ID NO: 32846 - protein, 234 aa, Staphylococcus aureus A9635
MKMTAIAKASLALSILATGVITSTAQTVDASEHESKYENVTKDIFDLRDYYSGASKELKNVTGYRYSKGGKHYLIFDKNRKFTRIQIFGKDIERIKARKNPGLDIFVVKEAENRNGTVYSYGGVTKKNKGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIDKIEANIR

SEQ ID NO: 32847 - protein, 282 aa, Staphylococcus aureus A9635
MKMTQIAKTSLALSLLTTGVSIVTTQSAKAEVASALKTEQTPKSNIQKATTSPSSKAEATQQTPSVTTTPPPNVQPQSPTTKQAQKEINPKYKDLRSYYTKPSLEFEKQFGFMLKPWTTVRFMNVIPDWFIYKIALVGKDDMKYKDGPYDNIDVFIVLEDNKYQLKKYSVGGITKTNSKKVDHKAELSITKKDEEGKISRDVSEYKITKEEISLKELDFKLRKQLIEQHNLYGNIGSGTIVIKMKNGGKYTFELHKKLQEHRMADVIDGTNIDRIEVNLKSS

SEQ ID NO: 32848 - protein, 343 aa, Staphylococcus aureus A9635
MKIRTIVKASLALGLVTTGASIVTTQSAKAEVASALKSEQLAMISVSPSAITTTTQAVNAEQNHTANPEQAAKSNTENVSTSPSTKTEQTPKSNIQKATQQTPSVTTTPPPNAQPQSTQPTPKPTTPPSSSVETPQPQSPTTKQAQKKINPKFKGLRSYYTKPSLEFKNELGIIIKKWTTIRFMNIVPDYFIYKIALVGKDDKKYGEGVHRHVDVFIVLEQNKYGVDKYSVGGITKANRKKVDYKAGISITKEDKNGTISHDVSEYKITKEEISLKELDFKLRKQLIEQHNLYGNIGSGTIVIKMKNGGKYTFELHKKLQEHRMADVIDGTNIDRIEVNLKSS

SEQ ID NO: 32849 - protein, 233 aa, Staphylococcus aureus A9635
MKMKSIAKVSLVLGILATGVNTVTEQPVHAENKHVQVSQNSKNLKAYYTQPSVEYKNVTGYISSIQPKPGTKFMNMIEGNTVNNLALVGKDKEHYHTGVHRNLDIFYVNEDKRFEGAKYSIGGITKASDKVVDQVAEARVIKEDHTGEYAYDFFPFKIDKEAMTLKEVDFKIRKHLIDHYGLYGEMSSGTVTVQMKYYGKYTIELDKKLQEDRMGDIVKVIDIDRIEVKVKKA

SEQ ID NO: 32850 - protein, 226 aa, Staphylococcus aureus A9635
MKFKAIAKASLALGMLATGVITSNTQSVQAKTEVKQQSEADLKLYYSGPSFEYKKVTGYGFIEGKDRFIDFIYNGQYNKISLVGSDKDKYNEEVNPDIDVFVVREGNGRQADNHSIGGVTKTNRGVYYDYIHTPILEIKKGKEEPQNSLYQIYKEDISLKELDYRLRERAIKQHGLYSNGLKQGQITITMKDGKSHTIDLSQKLEKERMGDSIDGRQIQKILVEMK

SEQ ID NO: 32851 - protein, 142 aa, Staphylococcus aureus A9635
MVKKLYDRYSKNTINGKSNKSRNWVYSERPLNENQVRIHLEGTYRVADRVYTPKRNITLNKEVVTLKELNHIIRFAHISYGLYMGEHLSKGDIVINTKDGGKYTLESHKELQKNRENVKINTADVKNVTFELVKSVNDIEQV

SEQ ID NO: 32852 - protein, 691 aa, Staphylococcus aureus A9635
MLRGQEERKYSIRKYSIGVVSVLAATMFVVSSHEAQASEKTPTSNAAAQKETLNQSGEQGNAITSHQMQSGKQLDDMHKKNDKSGTVTEGKDTLQSSKHQSTQNSKTIRTQNDDQVKQDSERQGSKQSHQNNATNKTERQNDQVLNTHHAERNGSQSTTSQSNDVDKSQPSIPAQKVITNHDKAATTSTTPPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGSELANFYIGIINDLLSVEATEGKGTQLKAS

SEQ ID NO: 32853 - protein, 715 aa, Staphylococcus aureus A9635
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPEPSPDPDPDSDSDSDSDSGSDSDSDSESDSDSDSDSGSDSDSDSESDSDSDSDSDSDSDSDSDSDSDSDSDSDSDSDSDSDSDSDSDSDSDSDSDSDSDSDSDSD

SEQ ID NO: 32854 - protein, 2273 aa, Staphylococcus aureus A9635
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTFSKNTTSSSDTKSVASTSSTEQPINTSTNQSTASNNTSQSTTPSSANLNKTSTTSTSTAPVKIRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 32855 - protein, 681 aa, Staphylococcus aureus A9635
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKNQLKDDKKSSLNNKNIQRDTTKNNNANPSDVNQGLEQAINDGKQSKAASQQQAKEAANSQGSNANNNLPLQSRTKESTSLNKSDQKSQPEIVRETEIEKVQPQQKNQSNDKMTSHHFNNEQEVNPQKDEKTLSVSDLKNNQKSPVEPTKDNDKKKGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKIHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTMQA

SEQ ID NO: 32856 - protein, 233 aa, Staphylococcus aureus A9635
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSAATWAAIIARESNGQVNAYNPSGASGLFQTMPGWGPTNTVDQQINAAVKAYKAQGLSAWGF

SEQ ID NO: 32857 - protein, 1053 aa, Staphylococcus aureus A9635
MKNNLRYGIRKHKLGAASVFLGTMIVVGMGQDKEAAASEQKTTTVEENGNSTTDNKVSETQTTTTNVNHIEETQSYNATVTEQPSNATQVTTEEAPKAVQAPQTAQPANVEKVKEEVVKEEAKPQVKETTQSQDNSGDQRQVDLIPKKATQNQVAETQVEVAQPRTVSESKPRVTRSADVVEAKEGMGVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTNEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHANVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNIGNQSFEEDTEEDKPKYEQGGNIVDIDFDSVPQIQGQNKGDQSFEEDTEKDKPKYEQGGNIVDIDFDSVPQIQGQNIGNQSFEEDTEKDKPKYEHGGNIIDIDFDSVPHIHGFNKHTEIIEEDTNKDKPSYQFGGHNGIDFVEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVVPTKQKQSKKSELPETGGEESTNKGMLFGGLFSILGLTLLRRNKKNNKA

SEQ ID NO: 32858 - protein, 973 aa, Staphylococcus aureus A9635
MKSNLRYGIRKHKLGAASVFLGTMIVVGMGQEKEAAASEQNNTTVEESGSSATESKASETQTTTNNVNTIDETQSYSATSTEQPSQSTQVTTEEAPITVQAPKVETEMKPQEDLPSEKVVEKETAGTQVDTTQPSNVSEIKPRMKRSADVAEVAEKEVVEKEVKATGTDVTSKVTVEEGSEIVGHNNKETNVVNPHNAERVTLKYKWKFGEDVKPGDYFDFTLSNNVETHGISTLRKVPEIKSTDGQVMAVGEVNEERKIRYTFKEYVQGKKDLKAELDLNLFIDPTTVTKRGNQNIEVTLGEKKISKQFDIKYLDGVKDRMGVTVNGRIDTLNKEGGKFSHFAYVKPNNQSLTSVTVTGQVTSGYKQNANKPTVKIYKHIGSDELAESVYAKLDDANKFEDVTNKVNLSYTGDGGYSLDFSDLDNSKDYVIKYEGEYDQNAKDLNFRTHLSGYHKNYPYYPNYYYPVQLTWNNGVAFYSNSAQGDGKDKPNDPIIDKSEPIELDIKSEPPVEKHELNGTIEESNDSKPIDFEYHTAVEGSEGHVEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPGEPTPPTPEVPSEPETPTPPTPEVPSEPETPTPPTPEVPSEPETPTPPTPEVPAEPGKPVPPAKEEPKKPSKPVEQGKVVTPVIEINEKVKPVAPTKQKQSKKSELPETGGEESTNKGMLFGGLFSILGLALLRRNKKNHKA

SEQ ID NO: 32859 - protein, 325 aa, Staphylococcus aureus A9635
MNMNKLVKSSVATSMALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNYKTRTFKSTYEIDWENHKVKLLDTKETEINK

SEQ ID NO: 32860 - protein, 315 aa, Staphylococcus aureus A9635; identical to SEQ ID NO: 30183

SEQ ID NO: 32861 - protein, 321 aa, Staphylococcus aureus A9635; identical to SEQ ID NO: 31900

SEQ ID NO: 32862 - protein, 241 aa, Staphylococcus aureus A9719; identical to SEQ ID NO: 30607

SEQ ID NO: 32863 - protein, 238 aa, Staphylococcus aureus A9719; identical to SEQ ID NO: 30606

SEQ ID NO: 32864 - protein, 241 aa, Staphylococcus aureus A9719; identical to SEQ ID NO: 30608

SEQ ID NO: 32865 - protein, 319 aa, Staphylococcus aureus A9719; identical to SEQ ID NO: 30605

SEQ ID NO: 32866 - protein, 274 aa, Staphylococcus aureus A9719; identical to SEQ ID NO: 30815

SEQ ID NO: 32867 - protein, 338 aa, Staphylococcus aureus A9719; identical to SEQ ID NO: 30627

SEQ ID NO: 32868 - protein, 351 aa, Staphylococcus aureus A9719; identical to SEQ ID NO: 30628

SEQ ID NO: 32869 - protein, 45 aa, Staphylococcus aureus A9719; identical to SEQ ID NO: 31097

SEQ ID NO: 32870 - protein, 241 aa, Staphylococcus aureus A9719; identical to SEQ ID NO: 30571

SEQ ID NO: 32871 - protein, 520 aa, Staphylococcus aureus A9719; identical to SEQ ID NO: 30906

SEQ ID NO: 32872 - protein, 233 aa, Staphylococcus aureus A9719; identical to SEQ ID NO: 30591

SEQ ID NO: 32873 - protein, 214 aa, Staphylococcus aureus A9719; identical to SEQ ID NO: 30966

SEQ ID NO: 32874 - protein, 157 aa, Staphylococcus aureus A9719; identical to SEQ ID NO: 30611

SEQ ID NO: 32875 - protein, 291 aa, Staphylococcus aureus A9719; identical to SEQ ID NO: 31911

SEQ ID NO: 32876 - protein, 97 aa, Staphylococcus aureus A9719
DSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32877 - protein, 172 aa, Staphylococcus aureus A9719
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 32878 - protein, 1075 aa, Staphylococcus aureus A9719
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 32879 - protein, 739 aa, Staphylococcus aureus A9719
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSD

SEQ ID NO: 32880 - protein, 891 aa, Staphylococcus aureus A9719; identical to SEQ ID NO: 30788

SEQ ID NO: 32881 - protein, 2186 aa, Staphylococcus aureus A9719; identical to SEQ ID NO: 30789

SEQ ID NO: 32882 - protein, 331 aa, Staphylococcus aureus A9719; identical to SEQ ID NO: 30615

SEQ ID NO: 32883 - protein, 327 aa, Staphylococcus aureus A9719
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQRELDRYTNQWNRLHWIGNNYKNQNTVTFTSTYEVDWQNHTVKLIGTDSKETNPGV

SEQ ID NO: 32884 - protein, 311 aa, Staphylococcus aureus A9719; identical to SEQ ID NO: 30617

SEQ ID NO: 32885 - protein, 258 aa, Staphylococcus aureus A9719; identical to SEQ ID NO: 30410

SEQ ID NO: 32886 - protein, 251 aa, Staphylococcus aureus A9719; identical to SEQ ID NO: 30946

SEQ ID NO: 32887 - protein, 136 aa, Staphylococcus aureus A9719; identical to SEQ ID NO: 30620

SEQ ID NO: 32888 - protein, 242 aa, Staphylococcus aureus A9719; identical to SEQ ID NO: 30399

SEQ ID NO: 32889 - protein, 239 aa, Staphylococcus aureus A9719; identical to SEQ ID NO: 30622

SEQ ID NO: 32890 - protein, 254 aa, Staphylococcus aureus A9719; identical to SEQ ID NO: 30809

SEQ ID NO: 32891 - protein, 2481 aa, Staphylococcus aureus A9719; identical to SEQ ID NO: 30631

SEQ ID NO: 32892 - protein, 723 aa, Staphylococcus aureus A9719
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSD

SEQ ID NO: 32893 - protein, 2271 aa, Staphylococcus aureus A9719; identical to SEQ ID NO: 30597

SEQ ID NO: 32894 - protein, 681 aa, Staphylococcus aureus A9719; identical to SEQ ID NO: 30598

SEQ ID NO: 32895 - protein, 96 aa, Staphylococcus aureus A9719; identical to SEQ ID NO: 30813

SEQ ID NO: 32896 - protein, 691 aa, Staphylococcus aureus A9719; identical to SEQ ID NO: 30511

SEQ ID NO: 32897 - protein, 203 aa, Staphylococcus aureus A9719; identical to SEQ ID NO: 30576

SEQ ID NO: 32898 - protein, 226 aa, Staphylococcus aureus A9719; identical to SEQ ID NO: 30577

SEQ ID NO: 32899 - protein, 231 aa, Staphylococcus aureus A9719; identical to SEQ ID NO: 30578

SEQ ID NO: 32900 - protein, 356 aa, Staphylococcus aureus A9719; identical to SEQ ID NO: 30579

SEQ ID NO: 32901 - protein, 292 aa, Staphylococcus aureus A9719; identical to SEQ ID NO: 30580

SEQ ID NO: 32902 - protein, 234 aa, Staphylococcus aureus A9719
MKMAAIAKASLALGILATGTITSLHQTVNASEHEAKYENVTKDIFDLRYYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 32903 - protein, 231 aa, Staphylococcus aureus A9719; identical to SEQ ID NO: 30582

SEQ ID NO: 32904 - protein, 234 aa, Staphylococcus aureus A9719; identical to SEQ ID NO: 32190

SEQ ID NO: 32905 - protein, 232 aa, Staphylococcus aureus A9719; identical to SEQ ID NO: 30584

SEQ ID NO: 32906 - protein, 227 aa, Staphylococcus aureus A9719; identical to SEQ ID NO: 30585

SEQ ID NO: 32907 - protein, 227 aa, Staphylococcus aureus A9719; identical to SEQ ID NO: 30586

SEQ ID NO: 32908 - protein, 905 aa, Staphylococcus aureus A9719
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSGSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 32909 - protein, 434 aa, Staphylococcus aureus A9719 [sequence omitted]

SEQ ID NO: 32910 - protein, 383 aa, Staphylococcus aureus A9719; identical to SEQ ID NO: 31488

SEQ ID NO: 32911 - protein, 96 aa, Staphylococcus aureus A9719
SDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 32912 - protein, 1124 aa, Staphylococcus aureus A9719
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETS

SEQ ID NO: 32913 - protein, 165 aa, Staphylococcus aureus A9719; identical to SEQ ID NO: 30418

SEQ ID NO: 32914 - protein, 109 aa, Staphylococcus aureus A9719; identical to SEQ ID NO: 30603

SEQ ID NO: 32915 - protein, 350 aa, Staphylococcus aureus A9719; identical to SEQ ID NO: 30602

SEQ ID NO: 32916 - protein, 645 aa, Staphylococcus aureus A9719; identical to SEQ ID NO: 30601

SEQ ID NO: 32917 - protein, 231 aa, Staphylococcus aureus A9719; identical to SEQ ID NO: 30630

SEQ ID NO: 32918 - protein, 1038 aa, Staphylococcus aureus A9719; identical to SEQ ID NO: 30590

SEQ ID NO: 32919 - protein, 961 aa, Staphylococcus aureus A9719; identical to SEQ ID NO: 30589

SEQ ID NO: 32920 - protein, 861 aa, Staphylococcus aureus A9719
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 32921 - protein, 325 aa, Staphylococcus aureus A9719; identical to SEQ ID NO: 30407

SEQ ID NO: 32922 - protein, 315 aa, Staphylococcus aureus A9719; identical to SEQ ID NO: 30573

SEQ ID NO: 32923 - protein, 321 aa, Staphylococcus aureus A9719; identical to SEQ ID NO: 30959

SEQ ID NO: 32924 - protein, 141 aa, Staphylococcus aureus A9719; identical to SEQ ID NO: 30633

SEQ ID NO: 32925 - protein, 809 aa, Staphylococcus aureus A9719; identical to SEQ ID NO: 30632

SEQ ID NO: 32926 - protein, 645 aa, Staphylococcus aureus A9754; identical to SEQ ID NO: 30747

SEQ ID NO: 32927 - protein, 350 aa, Staphylococcus aureus A9754; identical to SEQ ID NO: 30602

SEQ ID NO: 32928 - protein, 109 aa, Staphylococcus aureus A9754; identical to SEQ ID NO: 30744

SEQ ID NO: 32929 - protein, 165 aa, Staphylococcus aureus A9754; identical to SEQ ID NO: 30742

SEQ ID NO: 32930 - protein, 319 aa, Staphylococcus aureus A9754; identical to SEQ ID NO: 30741

SEQ ID NO: 32931 - protein, 238 aa, Staphylococcus aureus A9754; identical to SEQ ID NO: 30740

SEQ ID NO: 32932 - protein, 241 aa, Staphylococcus aureus A9754; identical to SEQ ID NO: 30739

SEQ ID NO: 32933 - protein, 241 aa, Staphylococcus aureus A9754; identical to SEQ ID NO: 30738

SEQ ID NO: 32934 - protein, 383 aa, Staphylococcus aureus A9754; identical to SEQ ID NO: 31779

SEQ ID NO: 32935 - protein, 325 aa, Staphylococcus aureus A9754; identical to SEQ ID NO: 30484

SEQ ID NO: 32936 - protein, 312 aa, Staphylococcus aureus A9754; identical to SEQ ID NO: 30196

SEQ ID NO: 32937 - protein, 234 aa, Staphylococcus aureus A9754; identical to SEQ ID NO: 30736

SEQ ID NO: 32938 - protein, 291 aa, Staphylococcus aureus A9754; identical to SEQ ID NO: 30390

SEQ ID NO: 32939 - protein, 807 aa, Staphylococcus aureus A9754; identical to SEQ ID NO: 30716

SEQ ID NO: 32940 - protein, 141 aa, Staphylococcus aureus A9754; identical to SEQ ID NO: 30715

SEQ ID NO: 32941 - protein, 309 aa, Staphylococcus aureus A9754; identical to SEQ ID NO: 30406

SEQ ID NO: 32942 - protein, 315 aa, Staphylococcus aureus A9754; identical to SEQ ID NO: 30440

SEQ ID NO: 32943 - protein, 325 aa, Staphylococcus aureus A9754; identical to SEQ ID NO: 30407

SEQ ID NO: 32944 - protein, 196 aa, Staphylococcus aureus A9754; identical to SEQ ID NO: 30587

SEQ ID NO: 32945 - protein, 141 aa, Staphylococcus aureus A9754
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIPKS

SEQ ID NO: 32946 - protein, 241 aa, Staphylococcus aureus A9754; identical to SEQ ID NO: 30776

SEQ ID NO: 32947 - protein, 51 aa, Staphylococcus aureus A9754; identical to SEQ ID NO: 32222

SEQ ID NO: 32948 - protein, 96 aa, Staphylococcus aureus A9754; identical to SEQ ID NO: 30813

SEQ ID NO: 32949 - protein, 274 aa, Staphylococcus aureus A9754; identical to SEQ ID NO: 30872

SEQ ID NO: 32950 - protein, 338 aa, Staphylococcus aureus A9754; identical to SEQ ID NO: 30699

SEQ ID NO: 32951 - protein, 351 aa, Staphylococcus aureus A9754; identical to SEQ ID NO: 30720

SEQ ID NO: 32952 - protein, 233 aa, Staphylococcus aureus A9754; identical to SEQ ID NO: 30428

SEQ ID NO: 32953 - protein, 1161 aa, Staphylococcus aureus A9754
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSD

SEQ ID NO: 32954 - protein, 719 aa, Staphylococcus aureus A9754
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 32955 - protein, 2271 aa, Staphylococcus aureus A9754; identical to SEQ ID NO: 32024

SEQ ID NO: 32956 - protein, 680 aa, Staphylococcus aureus A9754; identical to SEQ ID NO: 30700

SEQ ID NO: 32957 - protein, 895 aa, Staphylococcus aureus A9754; identical to SEQ ID NO: 30734

SEQ ID NO: 32958 - protein, 2186 aa, Staphylococcus aureus A9754; identical to SEQ ID NO: 31059

SEQ ID NO: 32959 - protein, 690 aa, Staphylococcus aureus A9754; identical to SEQ ID NO: 31973

SEQ ID NO: 32960 - protein, 203 aa, Staphylococcus aureus A9754; identical to SEQ ID NO: 30770

SEQ ID NO: 32961 - protein, 226 aa, Staphylococcus aureus A9754; identical to SEQ ID NO: 30769

SEQ ID NO: 32962 - protein, 231 aa, Staphylococcus aureus A9754; identical to SEQ ID NO: 30768

SEQ ID NO: 32963 - protein, 357 aa, Staphylococcus aureus A9754
MEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMAGTNIDNIEVNIK

SEQ ID NO: 32964 - protein, 308 aa, Staphylococcus aureus A9754; identical to SEQ ID NO: 31787

SEQ ID NO: 32965 - protein, 239 aa, Staphylococcus aureus A9754; identical to SEQ ID NO: 31982

SEQ ID NO: 32966 - protein, 231 aa, Staphylococcus aureus A9754; identical to SEQ ID NO: 31761

SEQ ID NO: 32967 - protein, 231 aa, Staphylococcus aureus A9754; identical to SEQ ID NO: 30560

SEQ ID NO: 32968 - protein, 237 aa, Staphylococcus aureus A9754; identical to SEQ ID NO: 31791

SEQ ID NO: 32969 - protein, 232 aa, Staphylococcus aureus A9754; identical to SEQ ID NO: 30765

SEQ ID NO: 32970 - protein, 227 aa, Staphylococcus aureus A9754; identical to SEQ ID NO: 30585

SEQ ID NO: 32971 - protein, 231 aa, Staphylococcus aureus A9754; identical to SEQ ID NO: 31073

SEQ ID NO: 32972 - protein, 133 aa, Staphylococcus aureus A9754
SDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 32973 - protein, 242 aa, Staphylococcus aureus A9754; identical to SEQ ID NO: 31991

SEQ ID NO: 32974 - protein, 242 aa, Staphylococcus aureus A9754; identical to SEQ ID NO: 31992

SEQ ID NO: 32975 - protein, 327 aa, Staphylococcus aureus A9754; identical to SEQ ID NO: 30538

SEQ ID NO: 32976 - protein, 311 aa, Staphylococcus aureus A9754; identical to SEQ ID NO: 30617

SEQ ID NO: 32977 - protein, 789 aa, Staphylococcus aureus A9754
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSD

SEQ ID NO: 32978 - protein, 434 aa, Staphylococcus aureus A9754 [sequence omitted]

SEQ ID NO: 32979 - protein, 632 aa, Staphylococcus aureus A9754
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSD

SEQ ID NO: 32980 - protein, 331 aa, Staphylococcus aureus A9754; identical to SEQ ID NO: 30732

SEQ ID NO: 32981 - protein, 244 aa, Staphylococcus aureus A9754
AQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 32982 - protein, 51 aa, Staphylococcus aureus A9754; identical to SEQ ID NO: 32234

SEQ ID NO: 32983 - protein, 996 aa, Staphylococcus aureus A9754
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSD

SEQ ID NO: 32984 - protein, 811 aa, Staphylococcus aureus A9754
MHLRENIIVKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQT

SEQ ID NO: 32985 - protein, 142 aa, Staphylococcus aureus A9754
MPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 32986 - protein, 130 aa, Staphylococcus aureus A9754
SDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 32987 - protein, 231 aa, Staphylococcus aureus A9763; identical to SEQ ID NO: 30630

SEQ ID NO: 32988 - protein, 645 aa, Staphylococcus aureus A9763; identical to SEQ ID NO: 30601

SEQ ID NO: 32989 - protein, 350 aa, Staphylococcus aureus A9763; identical to SEQ ID NO: 30602

SEQ ID NO: 32990 - protein, 109 aa, Staphylococcus aureus A9763; identical to SEQ ID NO: 30603

SEQ ID NO: 32991 - protein, 165 aa, Staphylococcus aureus A9763; identical to SEQ ID NO: 30418

SEQ ID NO: 32992 - protein, 214 aa, Staphylococcus aureus A9763; identical to SEQ ID NO: 30966

SEQ ID NO: 32993 - protein, 233 aa, Staphylococcus aureus A9763; identical to SEQ ID NO: 30591

SEQ ID NO: 32994 - protein, 1038 aa, Staphylococcus aureus A9763; identical to SEQ ID NO: 30590

SEQ ID NO: 32995 - protein, 961 aa, Staphylococcus aureus A9763; identical to SEQ ID NO: 30589

SEQ ID NO: 32996 - protein, 444 aa, Staphylococcus aureus A9763
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLI

SEQ ID NO: 32997 - protein, 321 aa, Staphylococcus aureus A9763; identical to SEQ ID NO: 30959

SEQ ID NO: 32998 - protein, 315 aa, Staphylococcus aureus A9763; identical to SEQ ID NO: 30573

SEQ ID NO: 32999 - protein, 325 aa, Staphylococcus aureus A9763; identical to SEQ ID NO: 30407

SEQ ID NO: 33000 - protein, 241 aa, Staphylococcus aureus A9763; identical to SEQ ID NO: 32458

SEQ ID NO: 33001 - protein, 2481 aa, Staphylococcus aureus A9763; identical to SEQ ID NO: 30631

SEQ ID NO: 33002 - protein, 241 aa, Staphylococcus aureus A9763; identical to SEQ ID NO: 30571

SEQ ID NO: 33003 - protein, 520 aa, Staphylococcus aureus A9763; identical to SEQ ID NO: 30906

SEQ ID NO: 33004 - protein, 83 aa, Staphylococcus aureus A9763
DSDSDSDSDSDSDSDSDSDSDSDAGKHTPVKPMSTTKDHHNKAKALPETGSENNGSNNATLFGGLFAALGSLLLFGRRKKQNK

SEQ ID NO: 33005 - protein, 141 aa, Staphylococcus aureus A9763; identical to SEQ ID NO: 30633

SEQ ID NO: 33006 - protein, 809 aa, Staphylococcus aureus A9763; identical to SEQ ID NO: 30632

SEQ ID NO: 33007 - protein, 826 aa, Staphylococcus aureus A9763
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDN

SEQ ID NO: 33008 - protein, 138 aa, Staphylococcus aureus A9763; identical to SEQ ID NO: 30785

SEQ ID NO: 33009 - protein, 291 aa, Staphylococcus aureus A9763
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKSWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 33010 - protein, 681 aa, Staphylococcus aureus A9763; identical to SEQ ID NO: 30598

SEQ ID NO: 33011 - protein, 2271 aa, Staphylococcus aureus A9763; identical to SEQ ID NO: 30597

SEQ ID NO: 33012 - protein, 649 aa, Staphylococcus aureus A9763
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQMISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWLYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSDSDSDSDSDSDSDSDTRFRIR

SEQ ID NO: 33013 - protein, 227 aa, Staphylococcus aureus A9763; identical to SEQ ID NO: 30586

SEQ ID NO: 33014 - protein, 227 aa, Staphylococcus aureus A9763; identical to SEQ ID NO: 30585

SEQ ID NO: 33015 - protein, 232 aa, Staphylococcus aureus A9763; identical to SEQ ID NO: 30584

SEQ ID NO: 33016 - protein, 234 aa, Staphylococcus aureus A9763; identical to SEQ ID NO: 32190

SEQ ID NO: 33017 - protein, 231 aa, Staphylococcus aureus A9763; identical to SEQ ID NO: 30582

SEQ ID NO: 33018 - protein, 234 aa, Staphylococcus aureus A9763; identical to SEQ ID NO: 30581

SEQ ID NO: 33019 - protein, 292 aa, Staphylococcus aureus A9763; identical to SEQ ID NO: 30580

SEQ ID NO: 33020 - protein, 356 aa, Staphylococcus aureus A9763; identical to SEQ ID NO: 30793

SEQ ID NO: 33021 - protein, 231 aa, Staphylococcus aureus A9763; identical to SEQ ID NO: 30578

SEQ ID NO: 33022 - protein, 226 aa, Staphylococcus aureus A9763; identical to SEQ ID NO: 30577

SEQ ID NO: 33023 - protein, 203 aa, Staphylococcus aureus A9763
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYTVADRVYTPKRNITLNKEFVTLKELDHIIRFAHISYGLYMGEHLPKGNIVINTKDGGKYTLESHKELQKDRENVKINTADIKNVTFKLVKSVNDIEQV

SEQ ID NO: 33024 - protein, 691 aa, Staphylococcus aureus A9763; identical to SEQ ID NO: 30511

SEQ ID NO: 33025 - protein, 260 aa, Staphylococcus aureus A9763; identical to SEQ ID NO: 30625

SEQ ID NO: 33026 - protein, 274 aa, Staphylococcus aureus A9763; identical to SEQ ID NO: 30815

SEQ ID NO: 33027 - protein, 338 aa, Staphylococcus aureus A9763; identical to SEQ ID NO: 30627

SEQ ID NO: 33028 - protein, 351 aa, Staphylococcus aureus A9763; identical to SEQ ID NO: 30628

SEQ ID NO: 33029 - protein, 44 aa, Staphylococcus aureus A9763; identical to SEQ ID NO: 30513

SEQ ID NO: 33030 - protein, 891 aa, Staphylococcus aureus A9763; identical to SEQ ID NO: 30788

SEQ ID NO: 33031 - protein, 2186 aa, Staphylococcus aureus A9763; identical to SEQ ID NO: 30789

SEQ ID NO: 33032 - protein, 331 aa, Staphylococcus aureus A9763; identical to SEQ ID NO: 30615

SEQ ID NO: 33033 - protein, 327 aa, Staphylococcus aureus A9763; identical to SEQ ID NO: 30616

SEQ ID NO: 33034 - protein, 311 aa, Staphylococcus aureus A9763; identical to SEQ ID NO: 30617

SEQ ID NO: 33035 - protein, 258 aa, Staphylococcus aureus A9763; identical to SEQ ID NO: 30410

SEQ ID NO: 33036 - protein, 251 aa, Staphylococcus aureus A9763; identical to SEQ ID NO: 30946

SEQ ID NO: 33037 - protein, 136 aa, Staphylococcus aureus A9763; identical to SEQ ID NO: 30620

SEQ ID NO: 33038 - protein, 242 aa, Staphylococcus aureus A9763; identical to SEQ ID NO: 30399

SEQ ID NO: 33039 - protein, 239 aa, Staphylococcus aureus A9763; identical to SEQ ID NO: 30622

SEQ ID NO: 33040 - protein, 254 aa, Staphylococcus aureus A9763; identical to SEQ ID NO: 30809

SEQ ID NO: 33041 - protein, 383 aa, Staphylococcus aureus A9763; identical to SEQ ID NO: 31488

SEQ ID NO: 33042 - protein, 241 aa, Staphylococcus aureus A9763; identical to SEQ ID NO: 30608

SEQ ID NO: 33043 - protein, 241 aa, Staphylococcus aureus A9763; identical to SEQ ID NO: 30607

SEQ ID NO: 33044 - protein, 238 aa, Staphylococcus aureus A9763; identical to SEQ ID NO: 30606

SEQ ID NO: 33045 - protein, 319 aa, Staphylococcus aureus A9763; identical to SEQ ID NO: 30605

SEQ ID NO: 33046 - protein, 77 aa, Staphylococcus aureus A9763
DSDSDSDSDSDSDSDSDAGKHTPTKPMSTVKDQHKTAKALPETGSENNNSNNGTLFGGLFAALGSLLLFGRRKKQNK

SEQ ID NO: 33047 - protein, 1126 aa, Staphylococcus aureus A9763
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDS

SEQ ID NO: 33048 - protein, 905 aa, Staphylococcus aureus A9763; identical to SEQ ID NO: 30600

SEQ ID NO: 33049 - protein, 434 aa, Staphylococcus aureus A9763 [sequence omitted]

SEQ ID NO: 33050 - protein, 956 aa, Staphylococcus aureus A9763
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDS

SEQ ID NO: 33051 - protein, 70 aa, Staphylococcus aureus A9763
SDSDSDSDSDAGKHTPVKPMSTTKDHHNKAKALPETGNENSGSNNATLFGGLFAALGSLLLFGRRKKQNK

SEQ ID NO: 33052 - protein, 97 aa, Staphylococcus aureus A9763; identical to SEQ ID NO: 32876

SEQ ID NO: 33053 - protein, 645 aa, Staphylococcus aureus A9765; identical to SEQ ID NO: 30747

SEQ ID NO: 33054 - protein, 350 aa, Staphylococcus aureus A9765; identical to SEQ ID NO: 30602

SEQ ID NO: 33055 - protein, 109 aa, Staphylococcus aureus A9765; identical to SEQ ID NO: 30744

SEQ ID NO: 33056 - protein, 165 aa, Staphylococcus aureus A9765; identical to SEQ ID NO: 30742

SEQ ID NO: 33057 - protein, 319 aa, Staphylococcus aureus A9765; identical to SEQ ID NO: 30741

SEQ ID NO: 33058 - protein, 238 aa, Staphylococcus aureus A9765; identical to SEQ ID NO: 30740

SEQ ID NO: 33059 - protein, 241 aa, Staphylococcus aureus A9765; identical to SEQ ID NO: 30739

SEQ ID NO: 33060 - protein, 241 aa, Staphylococcus aureus A9765; identical to SEQ ID NO: 30738

SEQ ID NO: 33061 - protein, 383 aa, Staphylococcus aureus A9765; identical to SEQ ID NO: 31779

SEQ ID NO: 33062 - protein, 234 aa, Staphylococcus aureus A9765; identical to SEQ ID NO: 30736

SEQ ID NO: 33063 - protein, 291 aa, Staphylococcus aureus A9765; identical to SEQ ID NO: 30390

SEQ ID NO: 33064 - protein, 321 aa, Staphylococcus aureus A9765; identical to SEQ ID NO: 30959

SEQ ID NO: 33065 - protein, 315 aa, Staphylococcus aureus A9765; identical to SEQ ID NO: 30440

SEQ ID NO: 33066 - protein, 325 aa, Staphylococcus aureus A9765; identical to SEQ ID NO: 30407

SEQ ID NO: 33067 - protein, 431 aa, Staphylococcus aureus A9765
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKS

SEQ ID NO: 33068 - protein, 646 aa, Staphylococcus aureus A9765
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDS

SEQ ID NO: 33069 - protein, 1503 aa, Staphylococcus aureus A9765
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNLIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESNSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 33070 - protein, 681 aa, Staphylococcus aureus A9765; identical to SEQ ID NO: 32025

SEQ ID NO: 33071 - protein, 434 aa, Staphylococcus aureus A9765 [sequence omitted]

SEQ ID NO: 33072 - protein, 266 aa, Staphylococcus aureus A9765; identical to SEQ ID NO: 30401

SEQ ID NO: 33073 - protein, 690 aa, Staphylococcus aureus A9765; identical to SEQ ID NO: 30419

SEQ ID NO: 33074 - protein, 233 aa, Staphylococcus aureus A9765; identical to SEQ ID NO: 30428

SEQ ID NO: 33075 - protein, 231 aa, Staphylococcus aureus A9765; identical to SEQ ID NO: 31073

SEQ ID NO: 33076 - protein, 917 aa, Staphylococcus aureus A9765
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPDIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKRNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 33077 - protein, 995 aa, Staphylococcus aureus A9765; identical to SEQ ID NO: 31038

SEQ ID NO: 33078 - protein, 520 aa, Staphylococcus aureus A9765
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNKKPGKEDNKKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33079 - protein, 241 aa, Staphylococcus aureus A9765; identical to SEQ ID NO: 30776

SEQ ID NO: 33080 - protein, 327 aa, Staphylococcus aureus A9765; identical to SEQ ID NO: 30538

SEQ ID NO: 33081 - protein, 311 aa, Staphylococcus aureus A9765; identical to SEQ ID NO: 30617

SEQ ID NO: 33082 - protein, 895 aa, Staphylococcus aureus A9765; identical to SEQ ID NO: 30734

SEQ ID NO: 33083 - protein, 817 aa, Staphylococcus aureus A9765
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDLTAI

SEQ ID NO: 33084 - protein, 225 aa, Staphylococcus aureus A9765; identical to SEQ ID NO: 30763

SEQ ID NO: 33085 - protein, 274 aa, Staphylococcus aureus A9765; identical to SEQ ID NO: 30872

SEQ ID NO: 33086 - protein, 338 aa, Staphylococcus aureus A9765; identical to SEQ ID NO: 30699

SEQ ID NO: 33087 - protein, 351 aa, Staphylococcus aureus A9765; identical to SEQ ID NO: 30720

SEQ ID NO: 33088 - protein, 51 aa, Staphylococcus aureus A9765; identical to SEQ ID NO: 32222

SEQ ID NO: 33089 - protein, 2478 aa, Staphylococcus aureus A9765
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANESTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 33090 - protein, 2186 aa, Staphylococcus aureus A9765
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVDIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 33091 - protein, 260 aa, Staphylococcus aureus A9765; identical to SEQ ID NO: 31068

SEQ ID NO: 33092 - protein, 925 aa, Staphylococcus aureus A9765
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 33093 - protein, 242 aa, Staphylococcus aureus A9765; identical to SEQ ID NO: 30536

SEQ ID NO: 33094 - protein, 242 aa, Staphylococcus aureus A9765; identical to SEQ ID NO: 30537

SEQ ID NO: 33095 - protein, 807 aa, Staphylococcus aureus A9765; identical to SEQ ID NO: 30716

SEQ ID NO: 33096 - protein, 141 aa, Staphylococcus aureus A9765; identical to SEQ ID NO: 30715

SEQ ID NO: 33097 - protein, 203 aa, Staphylococcus aureus A9765; identical to SEQ ID NO: 30770

SEQ ID NO: 33098 - protein, 96 aa, Staphylococcus aureus A9765; identical to SEQ ID NO: 30813

SEQ ID NO: 33099 - protein, 134 aa, Staphylococcus aureus A9765
KDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMPHSKPTTSEAPPSQNIHNEDSMYDASTE

SEQ ID NO: 33100 - protein, 133 aa, Staphylococcus aureus A9765
VHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 33101 - protein, 234 aa, Staphylococcus aureus A9765; identical to SEQ ID NO: 31052

SEQ ID NO: 33102 - protein, 231 aa, Staphylococcus aureus A9765; identical to SEQ ID NO: 31761

SEQ ID NO: 33103 - protein, 231 aa, Staphylococcus aureus A9765; identical to SEQ ID NO: 30560

SEQ ID NO: 33104 - protein, 234 aa, Staphylococcus aureus A9765; identical to SEQ ID NO: 32347

SEQ ID NO: 33105 - protein, 232 aa, Staphylococcus aureus A9765; identical to SEQ ID NO: 30765

SEQ ID NO: 33106 - protein, 227 aa, Staphylococcus aureus A9765; identical to SEQ ID NO: 30585

SEQ ID NO: 33107 - protein, 226 aa, Staphylococcus aureus A9765; identical to SEQ ID NO: 30769

SEQ ID NO: 33108 - protein, 231 aa, Staphylococcus aureus A9765; identical to SEQ ID NO: 30768

SEQ ID NO: 33109 - protein, 198 aa, Staphylococcus aureus A9765
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAK

SEQ ID NO: 33110 - protein, 1267 aa, Staphylococcus aureus A9765
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 33111 - protein, 110 aa, Staphylococcus aureus A9765
SDSDSDSDSDSDSDSDSDSDSDSDSDSDSDSDSDSDSRVTPPNNEQKTPSNPKGEVNHSNKVSKQHKTDALPETGDKSENTNATLFGAMMALLGSLLLFRKRKQDHKEKA

SEQ ID NO: 33112 - protein, 71 aa, Staphylococcus aureus A9781
DSDSDSDSDSDAGKHTPVKPMSTTKDHHNKAKALPETGSENNGSNNATLFGGLFAALGSLLLFGRRKKQNK

SEQ ID NO: 33113 - protein, 44 aa, Staphylococcus aureus A9781; identical to SEQ ID NO: 30513

SEQ ID NO: 33114 - protein, 351 aa, Staphylococcus aureus A9781; identical to SEQ ID NO: 30628

SEQ ID NO: 33115 - protein, 338 aa, Staphylococcus aureus A9781; identical to SEQ ID NO: 30627

SEQ ID NO: 33116 - protein, 274 aa, Staphylococcus aureus A9781; identical to SEQ ID NO: 30815

SEQ ID NO: 33117 - protein, 96 aa, Staphylococcus aureus A9781; identical to SEQ ID NO: 30813

SEQ ID NO: 33118 - protein, 2481 aa, Staphylococcus aureus A9781; identical to SEQ ID NO: 30631

SEQ ID NO: 33119 - protein, 664 aa, Staphylococcus aureus A9781
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDS

SEQ ID NO: 33120 - protein, 2271 aa, Staphylococcus aureus A9781; identical to SEQ ID NO: 30597

SEQ ID NO: 33121 - protein, 681 aa, Staphylococcus aureus A9781; identical to SEQ ID NO: 30598

SEQ ID NO: 33122 - protein, 122 aa, Staphylococcus aureus A9781; identical to SEQ ID NO: 32202

SEQ ID NO: 33123 - protein, 291 aa, Staphylococcus aureus A9781; identical to SEQ ID NO: 31911

SEQ ID NO: 33124 - protein, 124 aa, Staphylococcus aureus A9781
SDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33125 - protein, 254 aa, Staphylococcus aureus A9781; identical to SEQ ID NO: 30809

SEQ ID NO: 33126 - protein, 239 aa, Staphylococcus aureus A9781; identical to SEQ ID NO: 30622

SEQ ID NO: 33127 - protein, 242 aa, Staphylococcus aureus A9781; identical to SEQ ID NO: 30399

SEQ ID NO: 33128 - protein, 251 aa, Staphylococcus aureus A9781; identical to SEQ ID NO: 30946

SEQ ID NO: 33129 - protein, 258 aa, Staphylococcus aureus A9781; identical to SEQ ID NO: 30410

SEQ ID NO: 33130 - protein, 311 aa, Staphylococcus aureus A9781; identical to SEQ ID NO: 30617

SEQ ID NO: 33131 - protein, 327 aa, Staphylococcus aureus A9781; identical to SEQ ID NO: 32883

SEQ ID NO: 33132 - protein, 231 aa, Staphylococcus aureus A9781; identical to SEQ ID NO: 30630

SEQ ID NO: 33133 - protein, 2186 aa, Staphylococcus aureus A9781; identical to SEQ ID NO: 30789

SEQ ID NO: 33134 - protein, 331 aa, Staphylococcus aureus A9781; identical to SEQ ID NO: 30615

SEQ ID NO: 33135 - protein, 203 aa, Staphylococcus aureus A9781; identical to SEQ ID NO: 30576

SEQ ID NO: 33136 - protein, 226 aa, Staphylococcus aureus A9781; identical to SEQ ID NO: 30577

SEQ ID NO: 33137 - protein, 231 aa, Staphylococcus aureus A9781; identical to SEQ ID NO: 30578

SEQ ID NO: 33138 - protein, 356 aa, Staphylococcus aureus A9781; identical to SEQ ID NO: 30579

SEQ ID NO: 33139 - protein, 292 aa, Staphylococcus aureus A9781; identical to SEQ ID NO: 30580

SEQ ID NO: 33140 - protein, 234 aa, Staphylococcus aureus A9781; identical to SEQ ID NO: 32902

SEQ ID NO: 33141 - protein, 231 aa, Staphylococcus aureus A9781; identical to SEQ ID NO: 30582

SEQ ID NO: 33142 - protein, 232 aa, Staphylococcus aureus A9781; identical to SEQ ID NO: 30583

SEQ ID NO: 33143 - protein, 232 aa, Staphylococcus aureus A9781; identical to SEQ ID NO: 30584

SEQ ID NO: 33144 - protein, 227 aa, Staphylococcus aureus A9781; identical to SEQ ID NO: 30585

SEQ ID NO: 33145 - protein, 485 aa, Staphylococcus aureus A9781
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEE

SEQ ID NO: 33146 - protein, 961 aa, Staphylococcus aureus A9781; identical to SEQ ID NO: 30589

SEQ ID NO: 33147 - protein, 1038 aa, Staphylococcus aureus A9781; identical to SEQ ID NO: 30590

SEQ ID NO: 33148 - protein, 233 aa, Staphylococcus aureus A9781; identical to SEQ ID NO: 30591

SEQ ID NO: 33149 - protein, 214 aa, Staphylococcus aureus A9781; identical to SEQ ID NO: 30966

SEQ ID NO: 33150 - protein, 520 aa, Staphylococcus aureus A9781; identical to SEQ ID NO: 30906

SEQ ID NO: 33151 - protein, 241 aa, Staphylococcus aureus A9781; identical to SEQ ID NO: 30571

SEQ ID NO: 33152 - protein, 243 aa, Staphylococcus aureus A9781
MVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 33153 - protein, 259 aa, Staphylococcus aureus A9781; identical to SEQ ID NO: 30226

SEQ ID NO: 33154 - protein, 261 aa, Staphylococcus aureus A9781; identical to SEQ ID NO: 32500

SEQ ID NO: 33155 - protein, 321 aa, Staphylococcus aureus A9781; identical to SEQ ID NO: 30959

SEQ ID NO: 33156 - protein, 315 aa, Staphylococcus aureus A9781; identical to SEQ ID NO: 30573

SEQ ID NO: 33157 - protein, 325 aa, Staphylococcus aureus A9781; identical to SEQ ID NO: 30407

SEQ ID NO: 33158 - protein, 241 aa, Staphylococcus aureus A9781; identical to SEQ ID NO: 32458

SEQ ID NO: 33159 - protein, 809 aa, Staphylococcus aureus A9781; identical to SEQ ID NO: 30632

SEQ ID NO: 33160 - protein, 141 aa, Staphylococcus aureus A9781; identical to SEQ ID NO: 30633

SEQ ID NO: 33161 - protein, 905 aa, Staphylococcus aureus A9781; identical to SEQ ID NO: 30600

SEQ ID NO: 33162 - protein, 434 aa, Staphylococcus aureus A9781 [sequence omitted]

SEQ ID NO: 33163 - protein, 691 aa, Staphylococcus aureus A9781; identical to SEQ ID NO: 30511

SEQ ID NO: 33164 - protein, 136 aa, Staphylococcus aureus A9781
SDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33165 - protein, 1004 aa, Staphylococcus aureus A9781
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDS

SEQ ID NO: 33166 - protein, 165 aa, Staphylococcus aureus A9781; identical to SEQ ID NO: 30418

SEQ ID NO: 33167 - protein, 109 aa, Staphylococcus aureus A9781; identical to SEQ ID NO: 30603

SEQ ID NO: 33168 - protein, 350 aa, Staphylococcus aureus A9781; identical to SEQ ID NO: 30602

SEQ ID NO: 33169 - protein, 645 aa, Staphylococcus aureus A9781; identical to SEQ ID NO: 30601

SEQ ID NO: 33170 - protein, 1168 aa, Staphylococcus aureus A9781
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDS

SEQ ID NO: 33171 - protein, 965 aa, Staphylococcus aureus A9781; identical to SEQ ID NO: 30920

SEQ ID NO: 33172 - protein, 227 aa, Staphylococcus aureus A9781; identical to SEQ ID NO: 30586

SEQ ID NO: 33173 - protein, 383 aa, Staphylococcus aureus A9781; identical to SEQ ID NO: 31488

SEQ ID NO: 33174 - protein, 241 aa, Staphylococcus aureus A9781; identical to SEQ ID NO: 30608

SEQ ID NO: 33175 - protein, 241 aa, Staphylococcus aureus A9781; identical to SEQ ID NO: 30607

SEQ ID NO: 33176 - protein, 238 aa, Staphylococcus aureus A9781; identical to SEQ ID NO: 30606

SEQ ID NO: 33177 - protein, 319 aa, Staphylococcus aureus A9781; identical to SEQ ID NO: 30605

SEQ ID NO: 33178 - protein, 867 aa, Staphylococcus aureus CN79
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 33179 - protein, 1759 aa, Staphylococcus aureus CN79; identical to SEQ ID NO: 31045

SEQ ID NO: 33180 - protein, 809 aa, Staphylococcus aureus CN79; identical to SEQ ID NO: 31961

SEQ ID NO: 33181 - protein, 967 aa, Staphylococcus aureus CN79
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 33182 - protein, 807 aa, Staphylococcus aureus CN79; identical to SEQ ID NO: 30716

SEQ ID NO: 33183 - protein, 44 aa, Staphylococcus aureus CN79; identical to SEQ ID NO: 30513

SEQ ID NO: 33184 - protein, 681 aa, Staphylococcus aureus CN79; identical to SEQ ID NO: 31046

SEQ ID NO: 33185 - protein, 274 aa, Staphylococcus aureus CN79; identical to SEQ ID NO: 30872

SEQ ID NO: 33186 - protein, 257 aa, Staphylococcus aureus CN79; identical to SEQ ID NO: 30259

SEQ ID NO: 33187 - protein, 338 aa, Staphylococcus aureus CN79; identical to SEQ ID NO: 30699

SEQ ID NO: 33188 - protein, 895 aa, Staphylococcus aureus CN79; identical to SEQ ID NO: 30734

SEQ ID NO: 33189 - protein, 331 aa, Staphylococcus aureus CN79; identical to SEQ ID NO: 30732

SEQ ID NO: 33190 - protein, 281 aa, Staphylococcus aureus CN79
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQ

SEQ ID NO: 33191 - protein, 315 aa, Staphylococcus aureus CN79; identical to SEQ ID NO: 30440

SEQ ID NO: 33192 - protein, 350 aa, Staphylococcus aureus CN79; identical to SEQ ID NO: 30602

SEQ ID NO: 33193 - protein, 109 aa, Staphylococcus aureus CN79; identical to SEQ ID NO: 30744

SEQ ID NO: 33194 - protein, 372 aa, Staphylococcus aureus CN79; identical to SEQ ID NO: 31084

SEQ ID NO: 33195 - protein, 250 aa, Staphylococcus aureus CN79; identical to SEQ ID NO: 31910

SEQ ID NO: 33196 - protein, 242 aa, Staphylococcus aureus CN79; identical to SEQ ID NO: 30396

SEQ ID NO: 33197 - protein, 999 aa, Staphylococcus aureus CN79
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEVSCCTAYVKMKTTKF

SEQ ID NO: 33198 - protein, 242 aa, Staphylococcus aureus CN79
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLNKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDAENFHLDVEISYEKTE

SEQ ID NO: 33199 - protein, 352 aa, Staphylococcus aureus CN79; identical to SEQ ID NO: 30767

SEQ ID NO: 33200 - protein, 241 aa, Staphylococcus aureus CN79; identical to SEQ ID NO: 30739

SEQ ID NO: 33201 - protein, 231 aa, Staphylococcus aureus CN79; identical to SEQ ID NO: 30560

SEQ ID NO: 33202 - protein, 203 aa, Staphylococcus aureus CN79; identical to SEQ ID NO: 30770

SEQ ID NO: 33203 - protein, 232 aa, Staphylococcus aureus CN79; identical to SEQ ID NO: 31054

SEQ ID NO: 33204 - protein, 225 aa, Staphylococcus aureus CN79; identical to SEQ ID NO: 30763

SEQ ID NO: 33205 - protein, 190 aa, Staphylococcus aureus CN79; identical to SEQ ID NO: 30534

SEQ ID NO: 33206 - protein, 360 aa, Staphylococcus aureus CN79
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDRQSAFYEILNMPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNGVHVVKPGDTVNDIAKANGTTADKIAADNKLAAKNMIKPGQELVVDKKQPANHADANKAQALPETGEENPFIGTTVFGGLSLALGAALLAGRRREL

SEQ ID NO: 33207 - protein, 1131 aa, Staphylococcus aureus CN79
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33208 - protein, 226 aa, Staphylococcus aureus CN79; identical to SEQ ID NO: 30769

SEQ ID NO: 33209 - protein, 234 aa, Staphylococcus aureus CN79; identical to SEQ ID NO: 31052

SEQ ID NO: 33210 - protein, 227 aa, Staphylococcus aureus CN79; identical to SEQ ID NO: 30585

SEQ ID NO: 33211 - protein, 691 aa, Staphylococcus aureus CN79; identical to SEQ ID NO: 31040

SEQ ID NO: 33212 - protein, 233 aa, Staphylococcus aureus CN79; identical to SEQ ID NO: 31039

SEQ ID NO: 33213 - protein, 325 aa, Staphylococcus aureus CN79; identical to SEQ ID NO: 30407

SEQ ID NO: 33214 - protein, 141 aa, Staphylococcus aureus CN79; identical to SEQ ID NO: 30715

SEQ ID NO: 33215 - protein, 125 aa, Staphylococcus aureus CN79
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEV

SEQ ID NO: 33216 - protein, 645 aa, Staphylococcus aureus CN79; identical to SEQ ID NO: 30747

SEQ ID NO: 33217 - protein, 165 aa, Staphylococcus aureus CN79; identical to SEQ ID NO: 30742

SEQ ID NO: 33218 - protein, 319 aa, Staphylococcus aureus CN79; identical to SEQ ID NO: 31078

SEQ ID NO: 33219 - protein, 241 aa, Staphylococcus aureus CN79; identical to SEQ ID NO: 30738

SEQ ID NO: 33220 - protein, 321 aa, Staphylococcus aureus CN79; identical to SEQ ID NO: 30959

SEQ ID NO: 33221 - protein, 231 aa, Staphylococcus aureus CN79; identical to SEQ ID NO: 31073

SEQ ID NO: 33222 - protein, 2478 aa, Staphylococcus aureus CN79
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAAFVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 33223 - protein, 299 aa, Staphylococcus aureus CN79
MKVRTAKFNEKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 33224 - protein, 885 aa, Staphylococcus aureus CN79
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 33225 - protein, 96 aa, Staphylococcus aureus CN79; identical to SEQ ID NO: 30813

SEQ ID NO: 33226 - protein, 929 aa, Staphylococcus aureus CN79
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 33227 - protein, 351 aa, Staphylococcus aureus CN79; identical to SEQ ID NO: 30720

SEQ ID NO: 33228 - protein, 311 aa, Staphylococcus aureus CN79; identical to SEQ ID NO: 30617

SEQ ID NO: 33229 - protein, 2186 aa, Staphylococcus aureus CN79; identical to SEQ ID NO: 31059

SEQ ID NO: 33230 - protein, 231 aa, Staphylococcus aureus CN79; identical to SEQ ID NO: 30768

SEQ ID NO: 33231 - protein, 231 aa, Staphylococcus aureus CN79; identical to SEQ ID NO: 31761

SEQ ID NO: 33232 - protein, 238 aa, Staphylococcus aureus CN79; identical to SEQ ID NO: 30740

SEQ ID NO: 33233 - protein, 51 aa, Staphylococcus aureus CN79; identical to SEQ ID NO: 32234

SEQ ID NO: 33234 - protein, 434 aa, Staphylococcus aureus CN79 [sequence omitted]

SEQ ID NO: 33235 - protein, 308 aa, Staphylococcus aureus CN79; identical to SEQ ID NO: 31787

SEQ ID NO: 33236 - protein, 232 aa, Staphylococcus aureus CN79; identical to SEQ ID NO: 30765

SEQ ID NO: 33237 - protein, 221 aa, Staphylococcus aureus CN79; identical to SEQ ID NO: 31036

SEQ ID NO: 33238 - protein, 141 aa, Staphylococcus aureus D30; identical to SEQ ID NO: 30715

SEQ ID NO: 33239 - protein, 62 aa, Staphylococcus aureus D30; identical to SEQ ID NO: 32153

SEQ ID NO: 33240 - protein, 350 aa, Staphylococcus aureus D30; identical to SEQ ID NO: 30602

SEQ ID NO: 33241 - protein, 109 aa, Staphylococcus aureus D30; identical to SEQ ID NO: 30744

SEQ ID NO: 33242 - protein, 165 aa, Staphylococcus aureus D30; identical to SEQ ID NO: 30742

SEQ ID NO: 33243 - protein, 319 aa, Staphylococcus aureus D30
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWIDRSSERYKIDWEKEEMTN

SEQ ID NO: 33244 - protein, 238 aa, Staphylococcus aureus D30; identical to SEQ ID NO: 30740

SEQ ID NO: 33245 - protein, 241 aa, Staphylococcus aureus D30; identical to SEQ ID NO: 30738

SEQ ID NO: 33246 - protein, 309 aa, Staphylococcus aureus D30; identical to SEQ ID NO: 30406

SEQ ID NO: 33247 - protein, 203 aa, Staphylococcus aureus D30; identical to SEQ ID NO: 30770

SEQ ID NO: 33248 - protein, 690 aa, Staphylococcus aureus D30; identical to SEQ ID NO: 30419

SEQ ID NO: 33249 - protein, 2186 aa, Staphylococcus aureus D30; identical to SEQ ID NO: 31059

SEQ ID NO: 33250 - protein, 233 aa, Staphylococcus aureus D30; identical to SEQ ID NO: 30428

SEQ ID NO: 33251 - protein, 231 aa, Staphylococcus aureus D30; identical to SEQ ID NO: 31073

SEQ ID NO: 33252 - protein, 818 aa, Staphylococcus aureus D30
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 33253 - protein, 241 aa, Staphylococcus aureus D30
MKKLATVGSLIVTSTLVFSSMPFQNAHADTTSMNVSNKQSQNVQNHRPYGGVVPQGMTQAPYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 33254 - protein, 44 aa, Staphylococcus aureus D30; identical to SEQ ID NO: 30513

SEQ ID NO: 33255 - protein, 434 aa, Staphylococcus aureus D30
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTQILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 33256 - protein, 351 aa, Staphylococcus aureus D30; identical to SEQ ID NO: 30720

SEQ ID NO: 33257 - protein, 338 aa, Staphylococcus aureus D30; identical to SEQ ID NO: 30699

SEQ ID NO: 33258 - protein, 311 aa, Staphylococcus aureus D30; identical to SEQ ID NO: 30617

SEQ ID NO: 33259 - protein, 327 aa, Staphylococcus aureus D30; identical to SEQ ID NO: 30538

SEQ ID NO: 33260 - protein, 234 aa, Staphylococcus aureus D30; identical to SEQ ID NO: 31052

SEQ ID NO: 33261 - protein, 231 aa, Staphylococcus aureus D30; identical to SEQ ID NO: 30560

SEQ ID NO: 33262 - protein, 232 aa, Staphylococcus aureus D30; identical to SEQ ID NO: 31054

SEQ ID NO: 33263 - protein, 232 aa, Staphylococcus aureus D30; identical to SEQ ID NO: 30765

SEQ ID NO: 33264 - protein, 227 aa, Staphylococcus aureus D30; identical to SEQ ID NO: 30585

SEQ ID NO: 33265 - protein, 444 aa, Staphylococcus aureus D30; identical to SEQ ID NO: 32034

SEQ ID NO: 33266 - protein, 311 aa, Staphylococcus aureus KT/314250; identical to SEQ ID NO: 30617

SEQ ID NO: 33267 - protein, 645 aa, Staphylococcus aureus KT/314250; identical to SEQ ID NO: 31320

SEQ ID NO: 33268 - protein, 105 aa, Staphylococcus aureus KT/314250; identical to SEQ ID NO: 31317

SEQ ID NO: 33269 - protein, 165 aa, Staphylococcus aureus KT/314250; identical to SEQ ID NO: 31315

SEQ ID NO: 33270 - protein, 815 aa, Staphylococcus aureus KT/314250; identical to SEQ ID NO: 31288

SEQ ID NO: 33271 - protein, 327 aa, Staphylococcus aureus KT/314250; identical to SEQ ID NO: 30538

SEQ ID NO: 33272 - protein, 227 aa, Staphylococcus aureus KT/314250; identical to SEQ ID NO: 31334

SEQ ID NO: 33273 - protein, 350 aa, Staphylococcus aureus KT/314250; identical to SEQ ID NO: 30602

SEQ ID NO: 33274 - protein, 234 aa, Staphylococcus aureus KT/314250; identical to SEQ ID NO: 31339

SEQ ID NO: 33275 - protein, 232 aa, Staphylococcus aureus KT/314250; identical to SEQ ID NO: 31335

SEQ ID NO: 33276 - protein, 356 aa, Staphylococcus aureus KT/314250
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTQQTKMTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKNNLYGNVGSGKIVIKMKNGGKYTFELHKKLQENRMADVIDGTNIDNIEVNIK

SEQ ID NO: 33277 - protein, 231 aa, Staphylococcus aureus KT/314250; identical to SEQ ID NO: 31337

SEQ ID NO: 33278 - protein, 226 aa, Staphylococcus aureus KT/314250; identical to SEQ ID NO: 31343

SEQ ID NO: 33279 - protein, 141 aa, Staphylococcus aureus KT/314250; identical to SEQ ID NO: 30633

SEQ ID NO: 33280 - protein, 331 aa, Staphylococcus aureus KT/314250; identical to SEQ ID NO: 31305

SEQ ID NO: 33281 - protein, 230 aa, Staphylococcus aureus KT/314250; identical to SEQ ID NO: 31333

SEQ ID NO: 33282 - protein, 232 aa, Staphylococcus aureus KT/314250; identical to SEQ ID NO: 31593

SEQ ID NO: 33283 - protein, 231 aa, Staphylococcus aureus KT/314250; identical to SEQ ID NO: 31342

SEQ ID NO: 33284 - protein, 2186 aa, Staphylococcus aureus KT/314250; identical to SEQ ID NO: 31566

SEQ ID NO: 33285 - protein, 325 aa, Staphylococcus aureus KT/314250; identical to SEQ ID NO: 30484

SEQ ID NO: 33286 - protein, 232 aa, Staphylococcus aureus KT/314250; identical to SEQ ID NO: 31338

SEQ ID NO: 33287 - protein, 372 aa, Staphylococcus aureus KT/314250
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGGYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 33288 - protein, 350 aa, Staphylococcus aureus KT/314250; identical to SEQ ID NO: 31291

SEQ ID NO: 33289 - protein, 242 aa, Staphylococcus aureus KT/314250; identical to SEQ ID NO: 31294

SEQ ID NO: 33290 - protein, 44 aa, Staphylococcus aureus KT/314250; identical to SEQ ID NO: 30451

SEQ ID NO: 33291 - protein, 231 aa, Staphylococcus aureus KT/314250; identical to SEQ ID NO: 31073

SEQ ID NO: 33292 - protein, 338 aa, Staphylococcus aureus KT/314250; identical to SEQ ID NO: 31292

SEQ ID NO: 33293 - protein, 1371 aa, Staphylococcus aureus KT/314250
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33294 - protein, 312 aa, Staphylococcus aureus KT/314250; identical to SEQ ID NO: 30196

SEQ ID NO: 33295 - protein, 444 aa, Staphylococcus aureus KT/314250
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPK

SEQ ID NO: 33296 - protein, 1015 aa, Staphylococcus aureus KT/314250; identical to SEQ ID NO: 31279

SEQ ID NO: 33297 - protein, 274 aa, Staphylococcus aureus KT/314250; identical to SEQ ID NO: 30872

SEQ ID NO: 33298 - protein, 898 aa, Staphylococcus aureus KT/314250
MNMKKKEKHAIRKKSIGVASVLVGTLIGFGLLSSKEADASENSVTQSDSASNESKSNDSSSVSAAPKTNDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSDNDSDSDSGSDSGSDSTSDSGSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 33299 - protein, 957 aa, Staphylococcus aureus KT/314250; identical to SEQ ID NO: 31331

SEQ ID NO: 33300 - protein, 257 aa, Staphylococcus aureus KT/314250; identical to SEQ ID NO: 30259

SEQ ID NO: 33301 - protein, 957 aa, Staphylococcus aureus KT/314250; identical to SEQ ID NO: 31280

SEQ ID NO: 33302 - protein, 96 aa, Staphylococcus aureus KT/314250; identical to SEQ ID NO: 31559

SEQ ID NO: 33303 - protein, 241 aa, Staphylococcus aureus KT/314250; identical to SEQ ID NO: 31350

SEQ ID NO: 33304 - protein, 148 aa, Staphylococcus aureus KT/314250
GQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 33305 - protein, 426 aa, Staphylococcus aureus KT/314250
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDNKKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33306 - protein, 2275 aa, Staphylococcus aureus KT/314250; identical to SEQ ID NO: 31542

SEQ ID NO: 33307 - protein, 198 aa, Staphylococcus aureus KT/314250; identical to SEQ ID NO: 31544

SEQ ID NO: 33308 - protein, 242 aa, Staphylococcus aureus KT/314250; identical to SEQ ID NO: 31293

SEQ ID NO: 33309 - protein, 233 aa, Staphylococcus aureus KT/314250; identical to SEQ ID NO: 30428

SEQ ID NO: 33310 - protein, 949 aa, Staphylococcus aureus KT/314250
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSD

SEQ ID NO: 33311 - protein, 996 aa, Staphylococcus aureus KT/314250
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSINGEKVWDDKDNQDGKRPEKVSINLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 33312 - protein, 229 aa, Staphylococcus aureus KT/314250; identical to SEQ ID NO: 31309

SEQ ID NO: 33313 - protein, 1795 aa, Staphylococcus aureus KT/314250; identical to SEQ ID NO: 30558

SEQ ID NO: 33314 - protein, 291 aa, Staphylococcus aureus KT/314250; identical to SEQ ID NO: 30390

SEQ ID NO: 33315 - protein, 434 aa, Staphylococcus aureus KT/314250 [sequence omitted]

SEQ ID NO: 33316 - protein, 238 aa, Staphylococcus aureus KT/314250; identical to SEQ ID NO: 31313

SEQ ID NO: 33317 - protein, 241 aa, Staphylococcus aureus KT/314250; identical to SEQ ID NO: 30739

SEQ ID NO: 33318 - protein, 241 aa, Staphylococcus aureus KT/314250; identical to SEQ ID NO: 30411

SEQ ID NO: 33319 - protein, 681 aa, Staphylococcus aureus KT/314250; identical to SEQ ID NO: 32025

SEQ ID NO: 33320 - protein, 905 aa, Staphylococcus aureus KT/314250; identical to SEQ ID NO: 31276

SEQ ID NO: 33321 - protein, 690 aa, Staphylococcus aureus KT/314250; identical to SEQ ID NO: 31345

SEQ ID NO: 33322 - protein, 203 aa, Staphylococcus aureus KT/314250; identical to SEQ ID NO: 31344

SEQ ID NO: 33323 - protein, 895 aa, Staphylococcus aureus KT/314250; identical to SEQ ID NO: 31307

SEQ ID NO: 33324 - protein, 321 aa, Staphylococcus aureus KT/314250; identical to SEQ ID NO: 30959

SEQ ID NO: 33325 - protein, 319 aa, Staphylococcus aureus KT/314250; identical to SEQ ID NO: 30495

SEQ ID NO: 33326 - protein, 241 aa, Staphylococcus aureus KT/314250; identical to SEQ ID NO: 31311

SEQ ID NO: 33327 - protein, 325 aa, Staphylococcus aureus KT/314250; identical to SEQ ID NO: 30407

SEQ ID NO: 33328 - protein, 315 aa, Staphylococcus aureus KT/314250; identical to SEQ ID NO: 30573

SEQ ID NO: 33329 - protein, 91 aa, Staphylococcus aureus KT/314250
DSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33330 - protein, 677 aa, Staphylococcus aureus KT/Y21
MNMKKKEKHAIRKKSIGVASVLVGTLIGFGLLSSKEADASENSVTQSDSASNESKSNDSSSINAAPKTDNTNVSDTKTTSNTNNGETSVAQNPAQQETTQSSSTNATAEETPVTGEATTTTTNQANTPATTQSSNTNAEELVNQTSNETTSNDTNTVSSVNSPQNSTNAEKVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGSNTASKTVLIDYEKYGQFHNLSIKGTIDQIDKTNNTYRQTIYVNPSGDNVVLPVLTGNLIPKSNSNALIDANNTNIKVYKVDNADDLSHSYYVNPNDFEDVTDQVRISYPNDNQYKVEFPTDDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSGSDSDSDSDSDSDSDSDSDSDSDSDSDSDS

SEQ ID NO: 33331 - protein, 2481 aa, Staphylococcus aureus KT/Y21
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDGAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 33332 - protein, 893 aa, Staphylococcus aureus KT/Y21
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSMINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDISQNNTSEPLNVQTGQEDKVADTDVAENSSTATNPKDASDKADVIEPESDMVKDTDSSVDKDVQHDVDHLSDMLDNNHFDKYDLKEMDTQIAKDTDKGVDNSVGMSSNVDTDKDSNKNKDKVIQLAHIADKNKVNNTGTETNIDTMKYHPISTIKVTDKKATEHLPSDIHKTVDKTVKTKEKAGTPSKENKLSQSKMLPKTGETTSSQSWWGLYALLGMLALLIPKFRKESK

SEQ ID NO: 33333 - protein, 126 aa, Staphylococcus aureus KT/Y21
YTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDD

SEQ ID NO: 33334 - protein, 241 aa, Staphylococcus aureus KT/Y21; identical to SEQ ID NO: 31311

SEQ ID NO: 33335 - protein, 269 aa, Staphylococcus aureus KT/Y21
MSQPVYHLCLALKCKLIIVLGEFEVKYLTGFILILLLEGIFTNSASAIEYSDLHHKSKFDSKRLSNAKMSFINPTQLENKNTNDRLLKHDLLFHDMFVNVASKKDFKVEFENEALSKKFINKDIDIFAGSYSYECHGGATNKTQCSYGGVTLSDNNKYDDYKNIPCNLWIDGHQAEIELTAVKTKKKIVTIQELDVQLRNYLNEKYKLYEQGGDIVKGYVKYHNDDEQNVEYDFYNLNGEYGYEVLKMYADNKTINSDKLHLDIYLFKS

SEQ ID NO: 33336 - protein, 141 aa, Staphylococcus aureus KT/Y21; identical to SEQ ID NO: 30715

SEQ ID NO: 33337 - protein, 251 aa, Staphylococcus aureus KT/Y21; identical to SEQ ID NO: 30946

SEQ ID NO: 33338 - protein, 238 aa, Staphylococcus aureus KT/Y21; identical to SEQ ID NO: 30740

SEQ ID NO: 33339 - protein, 331 aa, Staphylococcus aureus KT/Y21
MSNQFKSEEERRQWEQFQAFQNQQNQQHQQYGQKKSKKRWFWGCGGCLLLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKDSVEKSESNEETAPVEPMPQSKPTTSEAPPSQNNHNENNMYDASTE

SEQ ID NO: 33340 - protein, 256 aa, Staphylococcus aureus KT/Y21; identical to SEQ ID NO: 30153

SEQ ID NO: 33341 - protein, 256 aa, Staphylococcus aureus KT/Y21
MAYQNFKSNMEGIINLKKLYIFLIAISLRMLTNSEEAYADVGVQNLRNYYGSYEFTDLKNQSDKNNPQSHQLEYEVEGKALYSQLSSEHDVKRLKSKKVDIFGIPYTGITQNVEYIYGGITLSNDYLDNARNIPINLWINGQHKTISTDRVSTNKKQVTAQEIDVKLRRYLQEEYNIYGHNKTNKGREYGNESKFNSGFDKGNVIFHLNNGTQFSYDLFYTGHGQPEDFLKVYNDNKTIDSENFHLDVDLFLSKTI

SEQ ID NO: 33342 - protein, 239 aa, Staphylococcus aureus KT/Y21
MKRILIIVVLLFCYSQNHIATADVGVLNLRNYYGSYPIEDHQSINPENNHLSHQLVFSMDNSTITAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 33343 - protein, 325 aa, Staphylococcus aureus KT/Y21; identical to SEQ ID NO: 30407

SEQ ID NO: 33344 - protein, 630 aa, Staphylococcus aureus KT/Y21
MNKQQKEFKSFYSIRKSSLGVASVAISTLLLLMSNGEAQAAAEETGGTNTEAQPKTEAVASPTTTSEKAPETKPVANAVSVSNKEVEAPTSETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 33345 - protein, 109 aa, Staphylococcus aureus KT/Y21
MKKNFIGKSILSIAAISLTVSTFAGESHAQTKNAETVKKYNEYQTNFKKQVNKKVVDAQKAVNLFKRTRTVATHRKAQRAVNLIHFQHSYEKKKLQRQIDLVLKYNTLK

SEQ ID NO: 33346 - protein, 242 aa, Staphylococcus aureus KT/Y21; identical to SEQ ID NO: 32821

SEQ ID NO: 33347 - protein, 44 aa, Staphylococcus aureus KT/Y21; identical to SEQ ID NO: 30513

SEQ ID NO: 33348 - protein, 319 aa, Staphylococcus aureus KT/Y21
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDCYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 33349 - protein, 2186 aa, Staphylococcus aureus KT/Y21
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 33350 - protein, 959 aa, Staphylococcus aureus KT/Y21
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVKLGRNTVSKTFNIQYLDGVKDRMGVTVNGRIDTLNKADGKFSHFAYVKPNNQSLTSVTVTGQVTSGYKQNVKNPTVKVYKHIGSDELAESIYAKLDDVSKFEDVTGELTLQYTSNGGYSLNFNNLDQSKNYVIKYEGDYDSNASTLEFQTHLFGYYNYYYYNTSNLTWKNGVAFYSNNAQGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENYQHISHSGLGTENGHGNYGVIEEIEENSHVDIKSELGYEGGQNSGNQSFEEDTEEDKPKYEQGGNIVDIDFDSVPQIQGQNNGDQSFEEDTEEDKPKYEQGGNIIDIDFDSVPHIHGFNKHTEIIEEDTNKDKPNYQFGGHSSVDFEEDTLPQVSGHNEGQQTIEEDTTPPIVPPTPPTPEVPSEPETPTPPTPEVPSEPETPTPPTPEVPSEPEVPTPPTPEIPSEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 33351 - protein, 434 aa, Staphylococcus aureus KT/Y21 [sequence omitted]

SEQ ID NO: 33352 - protein, 97 aa, Staphylococcus aureus KT/Y21
MVTAQEIDVKLRKYLQDEFNIYGHNDTGKGKEYGTSSKFYSGFDKGSVVFHMNDGSNFSYDLFYTGYGLPESFLKIYKDNKTVGSTQFHLDVEISKR

SEQ ID NO: 33353 - protein, 315 aa, Staphylococcus aureus KT/Y21; identical to SEQ ID NO: 30573

SEQ ID NO: 33354 - protein, 165 aa, Staphylococcus aureus KT/Y21
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMILQERIDQVLKQGLVR

SEQ ID NO: 33355 - protein, 350 aa, Staphylococcus aureus KT/Y21
MTKHYLNSKYQSEQRSSAMKKITMGTASIILGSLVYIGAGSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 33356 - protein, 96 aa, Staphylococcus aureus KT/Y21; identical to SEQ ID NO: 30813

SEQ ID NO: 33357 - protein, 338 aa, Staphylococcus aureus KT/Y21; identical to SEQ ID NO: 31292

SEQ ID NO: 33358 - protein, 350 aa, Staphylococcus aureus KT/Y21
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDNKSFREG

SEQ ID NO: 33359 - protein, 1038 aa, Staphylococcus aureus KT/Y21
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQVQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 33360 - protein, 551 aa, Staphylococcus aureus KT/Y21
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKVWEANISDLGLDKSEAYNFLITSSQRQGTSQGVYANGWMRTDLNNSTFKLTPNLVKKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKT

SEQ ID NO: 33361 - protein, 807 aa, Staphylococcus aureus KT/Y21
MTYKMKKWQKLSTITLLMAGVITLNGGEFRSIDKHQIAVADTNVQTPDYEKLRNTWLDVNYGYDKYDENNPDMKKKFDATEKEAEKLLKEMKTESGRTYLWENAKDLDTKSADMTRTYRNIEKIAEAMKHKDTKLKTDENKKKVKDALEWLHKNAYGKEPDKKVADLTSNFKNKTSRNTNLNWWDYEIGTPRALTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYRDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 33362 - protein, 241 aa, Staphylococcus aureus KT/Y21; identical to SEQ ID NO: 30739

SEQ ID NO: 33363 - protein, 259 aa, Staphylococcus aureus KT/Y21
MRKVFILITLLFGYSSYSLLEARAETQNDPNISELNKSSQYTGSWHNIWYLYNSDPVNAKKIKLSDKFLSHDFIVPINNPGHYDYVKTELKDSTMASSFDGKEVDIFGVNYFDQCYFSNENIQCDSNQGAGSKKTCMYGGITLNENNTNNRIQPIVVKVYENDSVTLSFDINIDKETVTIQELDYKVRNKLISKINLYHLGGTSYETGYIKFIENGNRYYWYDMMPDPGFTQSKYLMIYRGNETVESAKTEIEVHLTKK

SEQ ID NO: 33364 - protein, 250 aa, Staphylococcus aureus KT/Y21
MKLFFIFNFILNTIMSQTDYSDPTSNQLNKTSQYEGLMYNMKALYESDPVSFEKIKSYDQFLSFDLIYFYQTLQYNRIKTELTNDLSNYYKDKDVDLFGVKYFVNCYFSDNKDIKENSPSNDRVCMYGGVTEHEGNRTKLFGYTIVVSVYIDNRNSRSFTLSTNKDHITAQELDYNVRNQLIKDEQLYEFESSRFETGYIKFIENGKAVFWYDLMPPPNFTQSKYLMIYKDNKTLLSSKTAIEVHLTKKK

SEQ ID NO: 33365 - protein, 185 aa, Staphylococcus aureus KT/Y21
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARH

SEQ ID NO: 33366 - protein, 254 aa, Staphylococcus aureus KT/Y21; identical to SEQ ID NO: 30809

SEQ ID NO: 33367 - protein, 266 aa, Staphylococcus aureus KT/Y21
DSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSESDSDSDSDSDSDSDSDSDSDSDSNSDSDSDSDSDSDSDSDSDSDSDSDSDSDSDSDSDSDSASDSDSESDSNSDSESGSNNNVVPPNSPKNGTNASNKNEAKDSKEPLPDTGSEDEANTSLIWGLLASLGSLLLFRRKKENKDKK

SEQ ID NO: 33368 - protein, 232 aa, Staphylococcus aureus KT/Y21
MKLKNIAKASLALGILTTEMITTTAQPVKADEASSRLSVTSKDTQNLKTYYTGASFDLRGLSGYKEGDKVIFPQNGQQIDVTLTGKEGDVVQSNDDVTNVDVFAVPEGTGRSAIMTTIGGITTPNTQSYKDTTNNVNLRVSKSTSPNTISVSVKNYDIFKEKISLKELDFKLRKHLIDNHDLYKTEPKDSKIRINMKDGGYYTFELNKKLQTHRMGDVIDGTKIKEINVELN

SEQ ID NO: 33369 - protein, 546 aa, Staphylococcus aureus KT/Y21
MNKNVLKFMVFIMLLNIITPLFNKNEALAARDISSTNVTDLTVSPTKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGQSAISDFEKAFPGSKITVDNTKNTIDVTIPQGYGSYNSFSINYKTKITNEQQKEFVNNSQAWYQEYGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDK

SEQ ID NO: 33370 - protein, 953 aa, Staphylococcus aureus KT/Y21
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDRDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 33371 - protein, 1163 aa, Staphylococcus aureus KT/Y21
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQSQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33372 - protein, 266 aa, Staphylococcus aureus KT/Y21; identical to SEQ ID NO: 30426

SEQ ID NO: 33373 - protein, 233 aa, Staphylococcus aureus KT/Y21; identical to SEQ ID NO: 30428

SEQ ID NO: 33374 - protein, 232 aa, Staphylococcus aureus KT/Y21; identical to SEQ ID NO: 30584

SEQ ID NO: 33375 - protein, 369 aa, Staphylococcus aureus KT/Y21
MKMRTIAKTSLALGLLTTGAITVTTQSVKAEKVQSTIVDKVPTLKAERSAMINITTGANTGATQAANTRQERMPKLEKAPNTNEEKTSISKIEKISQPKQEAQKSLNISTTPAPKQEHSQTTTESTTQQTKVTTPPSTNTQQTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSVTKKDNQGMISHDVSEYMITKEEISLKELDFKLRKQLIEKHNLYGNMGSGTIVIKMKNGGKYTFELHKKLQEHRMADVIEGTNIDKIEVNIK

SEQ ID NO: 33376 - protein, 227 aa, Staphylococcus aureus KT/Y21
MKLTAIAKAALALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 33377 - protein, 300 aa, Staphylococcus aureus KT/Y21
MKITTIAKTSLALGLLTTGVITTTTQAAKASTPSSTKVEAPQSTPPSTKVEAPQSKPNATTPSSTKVEAPQQTANATTPPSTNTPQPMQSTKSDTPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 33378 - protein, 231 aa, Staphylococcus aureus KT/Y21
MKLKTLAKATLALGLLTTGVITSEGQAVQAKEKQERVQHLYDIKDLHRYYSSESFEFSNIRGKVENYNGSNVVRFNQDGQNHQLFLLGEDKAKYKQGLQGQDVFVVKELIDPNGRLSTVGGVTKKNNQSSETNTPLVVNKVYGGDLHASIDSFSINKEEVSLKELDFKIRKQLVEKYGLYKGTTKYGKITINLKDEKKEVIDLGDKLQFERMGDVLNSKDIQNIAVTINQI

SEQ ID NO: 33379 - protein, 226 aa, Staphylococcus aureus KT/Y21
MKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTPILEIKKDNEDVLKDFYYISKEDISLKELDYRLRERAIKQHGLYSNGLKQGQITITMNDGTTHTIDLSQKLEKERMGESIDGTKINKILVEIK

SEQ ID NO: 33380 - protein, 231 aa, Staphylococcus aureus KT/Y21
MKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33381 - protein, 241 aa, Staphylococcus aureus KT/Y21
MKKLATVGSLIVTSTLVFSSMPFQNAHADTTSMNVSNKQSQNVQNHRPYGGVVPQGMTQAQYTELEKALPQLSADSNMQDYNMKLYDATQNIADKYNVIITTNVGVFKPHAVRDMNGHALPLTKDGNFYQTNVDANGINHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 33382 - protein, 492 aa, Staphylococcus aureus KT/Y21
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNNFNKEQQNAFYEILHLPNLTEEQRNGFIQSLKDDPSVSKEILAEAKKLNDAQAPKEEDNKKPGKEDGNKPGKEDNNKPGKEDNNKPGKEDGNKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33383 - protein, 232 aa, Staphylococcus aureus KT/Y21; identical to SEQ ID NO: 30583

SEQ ID NO: 33384 - protein, 231 aa, Staphylococcus aureus KT/Y21
MKMKSIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 33385 - protein, 203 aa, Staphylococcus aureus KT/Y21
MFKKHHSKNSIVLKSILSLGIIYGGTFGIYPKGDASTQNSSSVQDKQFQKVEEVPNNSEKALVKKLYDRYSQNTINGKSNKSRNWVYSERPLNENQVRIHLEGTYTVAGRVYTPKRNITLNKEVVTLKELDHIIRFAHISYGLYMGEHLPKGNIVINTKDGGKYTLESHKELQKDRENVEINTDDIKNVTFELVKSVNDIEQV

SEQ ID NO: 33386 - protein, 690 aa, Staphylococcus aureus KT/Y21
MLRGQEERKYSIRKYSIGVVSVLAATMFVVSSHEAQASEKTPTNAAAQKETLNQPGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNGSQSTTSQSNDVDKSQPSIPAQKVIPNHDKAAPTSTTTPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRNQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 33387 - protein, 372 aa, Staphylococcus aureus KT/Y21; identical to SEQ ID NO: 30609

SEQ ID NO: 33388 - protein, 1405 aa, Staphylococcus aureus KT/Y21
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNAETLVDNNSNSNNENNADIILPKSTAPKRLNTRMRMAAIQPNSTDSKNVNNLITSTTTLTVVDADKNNKIVPAQDYLTLKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33389 - protein, 291 aa, Staphylococcus aureus KT/Y21
MKKIEAWLSKKGLKNKRTLIVVIAFVLFIIFLFLLLNSNSEDSGNITITENTELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 33390 - protein, 234 aa, Staphylococcus aureus KT/Y21
MKMTAIAKASLALGILATGTITSTHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 33391 - protein, 312 aa, Staphylococcus aureus KT/Y21; identical to SEQ ID NO: 30391

SEQ ID NO: 33392 - protein, 231 aa, Staphylococcus aureus KT/Y21
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSAVQANQVQSQEVEAPQNAQTQQPQASISNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 33393 - protein, 869 aa, Staphylococcus aureus KT/Y21
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVLQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNGKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33394 - protein, 325 aa, Staphylococcus aureus KT/Y21; identical to SEQ ID NO: 30484

SEQ ID NO: 33395 - protein, 257 aa, Staphylococcus aureus KT/Y21; identical to SEQ ID NO: 30159

SEQ ID NO: 33396 - protein, 1719 aa, Staphylococcus aureus KT/Y21
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSIASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGVVTLTQDTTSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDAKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVDSQSVSSSMSGSVSKSTSLSDSISNSSSTEKSESLSTSTSDSLRTSTSLSDSLSMSTSGSLSKSQSLSTSISGSSSTSASLSGSESESDSQSISTSASELTSESASTSLSDSTSTSNSGSSSTSTSLSTSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 33397 - protein, 203 aa, Staphylococcus aureus KT/Y21
YTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTLPDEPSKVDKDDQPKDNKTKPENPLKELPKTGMKIITSWITWVFIGILGLYLILRKRFNS

SEQ ID NO: 33398 - protein, 321 aa, Staphylococcus aureus KT/Y21; identical to SEQ ID NO: 30959

SEQ ID NO: 33399 - protein, 681 aa, Staphylococcus aureus KT/Y21
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSQIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIGQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 33400 - protein, 145 aa, Staphylococcus aureus KT/Y21
GSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 33401 - protein, 238 aa, Staphylococcus aureus O11
MNKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVAPAAKPSDKTYNLFVQYKDKLQTIIGAHKIYQGNKPVLTLKEIDFRAREALIKNNILYKENRNKGKLKITGGGNNYTIDLSKRLHSDLANVYVKNPNKITVDVLFD

SEQ ID NO: 33402 - protein, 241 aa, Staphylococcus aureus O11
MNNNITKKIILSTTLLLLGTASTQFPNTPISSSTEAKAYYINQNETNVNELTKYYSQKHLTFSNKTLWQKDNGTIHATLLQFSWYSHIQVYGPESWGNINQLRNKNVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 33403 - protein, 241 aa, Staphylococcus aureus O11
MKKNIMNKLVLSTALLLLGTTSTQLPKTPISFSSEAKAYNISENETNINELIKYYSQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLTLTDTNRYVKNPKNAQIEVILEKSN

SEQ ID NO: 33404 - protein, 372 aa, Staphylococcus aureus O11
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDIKISNTPKNSTQGNNLVVNNNEPTKEIKIANLEAQNSNQKKVNKGTNNYFGYYSFREAPKTQIYTVKKGDTLSAMALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 33405 - protein, 893 aa, Staphylococcus aureus O11
MNKHHPKLRSFYSIRKSTLGVASVIVSTLFLITSQHQAQAAENTNTSDKISENQNNNATTTQPPKDTNQTQPATQPANTAKNYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDEPETNYDYTKLVFAKPIYNDPSLVKSDTNDAVTTNDQSSSDASNQTNTNTSNQNTSTTNNANNQPQATTDMSQPAQPKSSANTDQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYIPDKAVYNAIVKVVVANIGYEGQYHVRIINQDIKTKDDDTSQNNTSEPLNVQTGQEDNVTATDTATNNSIETTPSEATDKVDLIEPESDMVKDTDSSVDKDAHHDVDHLSDMSGNTHFDKYDLKEMDTQIAKDTDKGVDNSVGMSSNVDTDKDSNKNKDKVIQLAHIADKNKVNNTGTETNIDTMKYHPISTIKVTDKKTTEHLPSDIHKTVDKTVKTKEKAGTPSKENKLSQSKMLPKTGETTSSQSWWGLYALLGMLTLFIPKFRKESK

SEQ ID NO: 33406 - protein, 291 aa, Staphylococcus aureus O11; identical to SEQ ID NO: 30390

SEQ ID NO: 33407 - protein, 109 aa, Staphylococcus aureus O11
MKKNFIGKSILSIAAISITVSTFAGESHAQTKNAETVKKYNEYQTNFKKQVNKKVVDAQKAVNLFKRTRTVATHRKAQRAVNLIHFQHSYEKKKLQRQIDLVLKYNTLK

SEQ ID NO: 33408 - protein, 165 aa, Staphylococcus aureus O11; identical to SEQ ID NO: 31315

SEQ ID NO: 33409 - protein, 322 aa, Staphylococcus aureus O11
MMKMKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 33410 - protein, 629 aa, Staphylococcus aureus O11
MNKQQKEFKSFYSIRKSSLGVASVAISTLLLLMSNGEAQAAEETGGTNTEAQPKTEAVASPSTTTEKAPEAKSVANAVSVSNKEVESPTSETKEVKPAAKSDNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSPSVEKENDASSESGKDKTPATKPAKAEVESSSTTPTKVVSTTQNVAKPTTTSSEKTIDVVQTSAGSSEAKDSAPLQKANIKNTNDGHTQSQNNKNTQENKAKSLPQTGEESNKDMTLPLMALLALSSIVAFVLPRKRKN

SEQ ID NO: 33411 - protein, 354 aa, Staphylococcus aureus O11
MTKHYLNSKYQSEQRSSAMKKITMGTASIILGSLVYIGADSQQVNAATEATNATNNQSAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQSAHTVKTTQTAQEQNKVQTPVKDVATAKSESNNQAVSDNKSQQTNKVTKQNEVHKQETSKDSKAKELPKTGLTSVDNFISTVAFATLALLGSLSLLLFKRKESK

SEQ ID NO: 33412 - protein, 296 aa, Staphylococcus aureus O11
SDSESDSDSDSDSDSESDSDSDSDSDSDSDSDSESDSDSDSDSDSESDSDSDSDSDSDSDSDSDSDSDSDSDSDSDSDSDSDSDSDSDSDSDSDSDSDSDSDSDSDSDSDSDSDSDSESDSDSDSDSDSESDSDSDSDSDSESDSDSDSDSDSDSDSDSDSDSDSDSDSDSDSDSDSESDSDSESDSDSDSDSDSDSDSDSESDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 33413 - protein, 214 aa, Staphylococcus aureus O11
MNKMKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTTNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 33414 - protein, 233 aa, Staphylococcus aureus O11
MKKTIMASSLAVALGVTGYAASTGHEAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 33415 - protein, 227 aa, Staphylococcus aureus O11
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMNQSNKKVLPAAGESMTSSILTAGIAALLLVSGLFLAFRRRSTNK

SEQ ID NO: 33416 - protein, 456 aa, Staphylococcus aureus O11
MMTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33417 - protein, 651 aa, Staphylococcus aureus O11
MLRGQEERKYSIRKYSIGVVSVLAATMFVVTSHEAQASEKTPTTNAAAQKETLNQPGEQGNAITSHQMQSGKQLDDMHKENGKSGTVTEGKDTLQSSKHQSTQNSKTIRTQNDNQVKQDSERQGSKQSHQNNAINKTERQNDQVQNTHHAERNGSQSTTSQSNDVDKSQPSIPAQKVIPNHDKAAPTSTTPPSNDKTAPKSTKTQDATTDKHPNQQDTHQPAHQIIDAKQDDTVHQSEQKPQVGDLSKHIDGQNSPEKPTDKNTDNKQLIKDALQAPKTRSTTNAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDCLVLKTF

SEQ ID NO: 33418 - protein, 141 aa, Staphylococcus aureus O11; identical to SEQ ID NO: 31189

SEQ ID NO: 33419 - protein, 251 aa, Staphylococcus aureus O11
MSLKMKNTIIKFLSTFIVLSSISLIDTSFTSKYNKISIAADAKNFTDLVEATKWGNSLIKSAKYSSKDKMAIYNYTKNSSPINTPLRSANGDVNKLPENIQEQVRQLDSTISKSITPDSVYVYRLLNLDYLSSITGFTREDLHMLQQTNNGQYDEALVSKLNNLMNSRIYRENGYSSTQLVSGAALAGRPIELKLELPKGTKAAYIDSKELTAYPGQQEVLLPRGTEYAVGSVKLSDNKRKIIITAVVFKK

SEQ ID NO: 33420 - protein, 331 aa, Staphylococcus aureus O11
MMVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33421 - protein, 338 aa, Staphylococcus aureus O11
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIENVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 33422 - protein, 351 aa, Staphylococcus aureus O11
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 33423 - protein, 29 aa, Staphylococcus aureus O11
MISMAQDIISTIGDLVKWIIDTVNKFTKK

SEQ ID NO: 33424 - protein, 856 aa, Staphylococcus aureus O11
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFSNIDIAIDKGHVNSTTGKTEFWATSSDVLKLKANYKIDDSVKEGDTFTFKYGQYFRPDSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTAYVNQPKNTYTKQTFVTNLTGYKFNPNAKNFKIYEVTDQNQFVDSFTPDTSKLKDVTGQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNWTLDSGFYKTPKYSLGDYVWYDSNKDGKQDSTEKGIKDVKVTLLNEKGEVIGTTKTDENGKYRFDNLDSGKYKVIFEKPAGLTQTGTNTTKDDKDADGGEVDVTITDHDDFTLDNGYFEEETSDSDSDSDSDSDSDSDSDSDSDSDSDSDSDSDSDSDSDSDSESDSDSDSDSDSDSDSDSDSDSDSDSDSDSDSDSDSDSDSDSDSDSDAGKHTPAKPMSAVKDHHNKAKALPETGSENNGSNNATLFGGLFAALGSLLLFGRRKKQNK

SEQ ID NO: 33425 - protein, 681 aa, Staphylococcus aureus O11
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEALPLNKSNQTSQREIVNKTEIEKVQPQQNNQANDKITNYNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 33426 - protein, 1778 aa, Staphylococcus aureus O11
MGLPFISHSIVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPPSANLNKTSTTSTSTAPVKLRTFSRLAMSTFASAATTTALTANTITVNKDNLKQYMTTSGNATYDQSTGIVTLTQDTYSQKGAITLGTRIDSNKSFHFSGKVNLGNKYEGHGNGGDGIGFAFSPGVLGETGLNGAAVGIGGLSNAFGFKLDTYHNTSTPNSAAKAKADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPAVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESGSTSESISISNSISNSVSASTSKSDSQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSGSESVSESSSLSDSISMSDSTSTSDSDSLSGSISLSGSTSLSTSDSLSDSKSLSSSQSMSGSESTSTSVSDSQSSSTSNSQFDSMSISASESDSMSTSDSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSISDSTSTSESLSTSGSTSGSVRMSESQSTSGSMITSQSDSTSISESLSSSNSGSTSVSESLSTSNSGSTSVSESLSTSGSGSTSVSDSSSTSSSLSTSGSTSVSDSTSMSESESVSTSASTSLSTSNSESASVSMSNSTSTSMSDSTSMSDSESVPTSASTSLSTSNSESASVSMSDSTSTSMSNSMSMSTSESNSIHPSNSMSTSQTHFTSTSISTSESIAPNTNESQSTLSATSEATKHNGTRAQREERLPDTGDSIKQNGLLGGVMTLLVGLGLMKRKKKKDENDQDDSQA

SEQ ID NO: 33427 - protein, 678 aa, Staphylococcus aureus O11
MKKRIDYLSNKQNKYSIRRFTVGTTSVIVGATILFGIGNHQAQASEQSNDTTQSSKNNASADSEKNNTIETPQLNTTANDTSDISANTNSANVDRTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNEKENINGQFSLPLFTDRAKAPKSGTYPANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTGEFNNRIFYEHPNVASINFGDITKTYVVLVEGHYDNTGKNLKTQVIQENIDPATGKDYSIFGWNNENVVRYGGGSADGDSAVNPKDPTPGPPVDPEPEPEPTPDPEPSPDPDPEPTPDPEPSPEPDPDSDSDSDSDSDSESGSDSDSGSDSDSDSDSNSDSDSESDSDSDSDSDSESDSDSDSDSDSDSDSDSESDSDSDSDSDSESDSDSDSDSDSDS

SEQ ID NO: 33428 - protein, 321 aa, Staphylococcus aureus O11
MNLKLNRKKVISMIKNKILTATLAVGLIAPLANPFIEISRAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDQTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 33429 - protein, 315 aa, Staphylococcus aureus O11; identical to SEQ ID NO: 30573

SEQ ID NO: 33430 - protein, 2154 aa, Staphylococcus aureus O11
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPAPIQPSASPAQNNNHSDANSTATETVSNANNNDVVSNNTTLNVPNRTNENGSGGHLTLKEIQEDVRHSSDKPELVAIAEQASNRPKKRSRRAAPADPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPDNVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNGLKRRAQTILDENRNNVPLNKRVSQADIDSLTNQMQHTLIRSVDAENAVNKKVDQMEDLVNQNDELTDEEKQAAIQVIEEHKNEIIGDIGDQTTDAGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKDAALNELTQATNHALEQINQATTNADVDNAKGDGLNAINPIAPVTVVKQAARDAVSHDAQQHIAEINANPDATQEERQAAIDKVNAAVTAANTNILNANTNANVEQVKTNAIQGIQAITPATKVKTDAKNAIDKSAETQHNTIFNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALTKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPEHIVRAGARGAVKQQYEAKKQEIEQAEHATDEEKQVALNQLANNEKLALQNINQAVTNNDVKRVETNGIATLKGVQPHIVIKPEEQQAIKASAENQVESIKDTPHATVDELDEANQLISDTLKKAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNAAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKVIQSAPKVCTPIIKEETHESRKVEKELPNTGSEGMDLPLKEFALITGAALLARRRTKNEKES

SEQ ID NO: 33431 - protein, 259 aa, Staphylococcus aureus O11
FEKPAGLTQTGTNTTEDDKDADGGEVDVTITDHDDFTLDNGYFEEDTSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33432 - protein, 2483 aa, Staphylococcus aureus O11
MNLFRQQKFSIRKFNVGIFSALIATVTFISTNPTTASAAEQNQPAQNQPAQPADANTQPNANAGAQANPTAQPAAPANQGQPAAQPAAQPANQGGQANPAGGAAQPNTQPAGQGNQADPNNAAQAQPGNQAAPANQAGQGNNQATPANQTQPANAPAVAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLDQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNTTNEEVAEADAAVEAAQKQGLHDIQVVKSKQEVVETKSKVLDKINAIQTHAKVKPAADTEVENAYNTRKQEIQNSNASTTEEKQAAYTELDTKKQEARTNLDAANSNSEVATAKDNGITAINQVQAATTKKSDAKAEIAQKASERKTAIEAMNDSTTEEQQAAKDKVDQAVVTANTDIDNAAANTDVDNAKTTNEATIAAITPDANVKPTAKQAIADKVQAQETAIDANNGATTEEKATAKQQVQTEKTTADTAIDGAHSNAEVEAAKNAEIAKIEAIQPATTTKDDAKQAITTKANERKTAIAQTQDITAEEIAAANANVDNAVTQANSNIEAANSQNDVEQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQVAPTSVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADVQGITADTTIKDVAKDELATKAKEQKALIAQTADATTEEKEQANQQVDAELTQGNQNIENAQSIDDVNTAKDNAIQAIDPILASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQVIDAKAEETKESIDQSDQLTAEEKTEALAMIKQITDQAKKGITDATTTAEVEKVKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNANADTSSTTTNNQNDAATGGTTATSTNNPSTDDANDKPQANNNSSADASTNSPTMDNDVTSKPEVESTNNGTTDKPATETDNATPAESTINNNSTTTATNENAPTGSTATAPTTASTEAASSADSKDNAAVNDSKQNAEVNNSAESQSTNGKVAQPKSENKAKAEKDGRDSTNQSMVESTTETLPSADITEPKVSSNTEKDKKESTTNQTDAEQHNSDTNVTSNEVVKSPSKADTDVSNKPSTSKPSEAKDKMTSTNVSQTDDTATADTNDTQKSVGSAANNKVKDMQTNDMKAPLATVSKGSNSANQDMLKVTNTDKHQAKATSAQQGKVNKPKQQAKTLPDTGMSHNDDLPYAELALGAGMAFLIRRFTKKDQQTEE

SEQ ID NO: 33433 - protein, 231 aa, Staphylococcus aureus O11
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSAVQANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 33434 - protein, 369 aa, Staphylococcus aureus O11
MKMRTIAKTSLALGLLTTCAITVTTQSVKAEKVQSTKVDKVPTLKGERLAMINITTGANTATTQAANTRQERTSKLEKAPNTNEEKTSTSKIEKISQPKQEAQKSLNISATPAPKQEQSQTTTESATPKTKVTTPQSINTQQTKVTTPPSTNTPQPMQSTKSDTPQSPTIKQAQTDMTPKYEGLRSYYTKPSFEFEKQFGFMLKPWTTVRFMNVIPNRFIYKIALVGKDEKKYKDGPYDNIDVFIVLEDNKYQLKKYSVGGITKTNSKKVDHKAELSITQENNQGTISRDVSEYMITKEEISLKELDFKLRKQLIEKHNLYGNMGSGTIVIKMKNGGKYTFELHKKLQEHRMADVIEGTNIDKIEVNIK

SEQ ID NO: 33435 - protein, 231 aa, Staphylococcus aureus O11
MKMKNIAKISLLLGILATDVNTTTEKPVHAEKKPIVISENSKKLKAYYNQPSIEYKNVTGYISFIQPSIKFMNIIDGNSVNNIALIGKDKQHYYTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 33436 - protein, 226 aa, Staphylococcus aureus O11
MKFKAIAKASLALGMLATGVITSNIQSVQAKTEVKQQSEADLKHYYNKPILERKNVTGYGFTDKGQHYLEVTVGQQHSLITLLTSDKDKYNKDVNSNIDVFILREGDSRQATNYSIGGVTKSNSVQYIDYINTPILEIKKGNEDVLKDFYYISKEDISLKELDYRLRERAIKQHGLYSNGLKQGQITITMNDGTTHTIDLSQKLEKERMGESIDGRQIQKILVEIK

SEQ ID NO: 33437 - protein, 203 aa, Staphylococcus aureus O11; identical to SEQ ID NO: 30343

SEQ ID NO: 33438 - protein, 231 aa, Staphylococcus aureus O11
MKLKNIAKASLALGILTTGMITTTAQPVKAKSMDSSLTAISNDTKKLKDYYTGDSFDYKNLKGYREGNIATFIFNSQQIDVTLTENEKNKFEDGNGIQNVDVFVVREGSGRQATDYSIGGISKTNGDNYKDYVNRPHIEVKREKGMVTTVKSDTDFYINKEEISLKELDFKLRKHLIDRHDLYKTEPKDSKIKVTMKNGGYYTFELNKKLQPHRMGDTIDSRNIEKIEVDL

SEQ ID NO: 33439 - protein, 308 aa, Staphylococcus aureus O11
MFKRKLLVTTLSLGLIVPIATPFQGSKATTNAEDIGDDAEVIKRTEDVSSRKWGVTQNVQFDFVKDKKYNKDALIIKMQGFINSRTTFNDVKQNRANKRMVWPFQYNIGLTSKDQNTSLINYLPKNKIETVDVGQTLGYNIGGKFQSAPSIGGNGSFNYSKSIKYSQKSYVSEVEQQSSKTIKWGVKANSFVIAGHRWSAYDELLFIRNTTRGPNARDYFVDDNELPPLITSGFNPSFIATVSHEKDSGDTSEFEITYGRNMDVTYATYLPKLGLYPERKHNEFVNRNFVVKYEVNWKTYEIKVKGHN

SEQ ID NO: 33440 - protein, 322 aa, Staphylococcus aureus O11; identical to SEQ ID NO: 30469

SEQ ID NO: 33441 - protein, 3125 aa, Staphylococcus aureus O11
MNYRDKIQKFSIRKYTVGTFSTVIATLVFLGFNTSQAHAAETNQPASVVKQKQQSNNEQNENRESQAQNSQNSQNGQSLSATHENEQPNISQANLVDQKVAQSSTTNDEQPASQNVNTKKDSATAATTQPDKEESKHKQNESQSANKNGNDSRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSSYQNADSSYYVENANDGSGYPVGTYINASNKGAPYYLPTAPWNTLKASAAKEIVLMTAKQTGDGYQWVIKFNKGHAPHENMIFWFALPSDQVPVGRTDFVTVNADGTNVQWSIGAGQGANKPLPQMWPYGVNDSRSRDFKVRSRSGQVIYDWSNVHVNTLRDLARAGDYFSEAGAPAATKAIGEQTFKYINGERPTESPGASTVYTFIGAGDASYTISFKTQGPTTNKLYYAAGGRALEYNQLFMYSQLYVESTQDHQQRLDGLRQTVNRTYRIGTTKNVEVGQNNYKMKKVLESTNLNIDDFIDDPLSYVRTPSNKVLGFYPTNANTNAFRPGGAQQLNEYQLSQLFTDQKLQEAARTRNPIRLMIGFDYPDGHGNAETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHTGIKNTTITTLPNGWTSNLTKADKNNGSLSITGRVSMNQTFNSDITFKVSATDNANNTTNDSQSKHVSIHVGKISEDAHPIVLGNTEKVVAVNPTAVSNDEKQSIITAFMNKNQNIRGYLASTNPVTVDNNGNVTLHYRDGSSTTLDATNVMTYEPIVKPEYQTTNAPKTATVTIAKGQSFNIGDIKQYFTLSNGQGIPSGTFTNITSDRTIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKAQAEAGGRPNYRTTGYSQANASSDGQRQYTLNGQVIQILDIINPSNGYGGQPVTNSNTRANHSNATVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPTTSQITGTVDNNHQHVSATAPNVTSATTKTINLLATDTSGNTATTSFNVTVKPLRDKYRVGTSSTAANPVRIANISNNATVSQADQTAIINSLTFTSNAPNRNYATASANEITSKTVSNVSRTGNNANVTVTVTYQDGTTSTVTVPVKHVIPEIVAHSHYTVQGQDFPAGNGSSASDYFKLSNGSAIPDATITWVSGQAPNKDNTRIGQDINVTAHILIDGETTPITKTATYKVVSSVPKHVFETNRGAVFPGVSDVYDAKQYVKPVNDSWTQNAQRMNFQFTNSYGPSKDVVGISTRDIRVTYDNHQTQIIKILAKVKPDPPRIDGNSVTYKAGLTNQQIKINNVLSSSSIKLFKADNTPLTITNTTYGSGNTAVVTVSDALPNGVIKARSSITMNNVTYTTQDEHGRAIDVTRNESVDSNDSATVTVTPQLQATTEGAVFIKGGDGFDFGHVERFIQNPPHGATVAWHDNPDTWKNTVGNTHKTAVVTLPSGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNANGLPTDGFTYKWNNAATGTNDANWAAMNKPNAAKVVNAKYDVIYNGRTFATSLPAKFVVKDVQPAKPTVTETAAGAITIAPGANQTVNTHAGNVTTYADKLVIKRNGNVVTTFTRHNNTSPWVKEASAATVAGIAGTNNGITVAAGTFNPADTIQVVATQGSGETVSDEQRSDDFTVVAPQPNQATTKIWQNGHIDITPNNPSGHLINPTQAMDIAYTEKVGNGAEHSKTINVVRGQNNQWTIANKPDYVTLDAQTGKVTFNANTIKPNSAITITPKAGTGHSASSNPSTLTAPATHTVNTTEIVKDYGSNVTAAEINNAVQVANKRTATIKNGTAMPTNLAGGSTTTIPVTVTYNDGSTEEVQESIFTKADKRELITAKNHLDDPVSTDGKKPGTITQYNNAIHNAQQQINTAKTEAQQVINNERATPQQVSDALTKVRAAQTKIDQAKALLQNKEDNSQLVTSKNNLQSSVNQVPSTAGMTQQSIDNYNAKKREAESEITAAQRVIDNGDATAQQISDEKHRVDNALTALNQAKQNLTADTHALEQAVQQLNRTGTTTGKKPASITAYNNSIRALQSDLTSAKNSANAIIQKPIRTVQEVQSALTNVNRVNERLTQAINQLVPLADNSALRTAKTKLDEEINKSVTTDGMTQSSIQAYENAKRAGQTESTNAQNVINNGDATDQQIAAEKAKVEEKYNSLKQAIAGLTPDLAPLQAAKTQLQNDIDQPTSTTGMTSASVATFNEKLSAARTKIQEIDRVLASHPDVATIRQNVTAANAAKSALDQARNGLTVDKAPLENAKNQLQHSIDTQTSTTGMTQDSVNAYNAKLTAARNKIQKINQVLAGSPTVDQINTNTSAAIQAKSDLDHARQALTPDKAPLQTAKTQLEQSINQPTDTTGMTIASLNAYNQKLQAARQKLTEINQVLNGNPTVQNINDKVAEANQAKDQLNTARQGLTLDRQPALTTLHGASNFKPSTTK

SEQ ID NO: 33442 - protein, 331 aa, Staphylococcus aureus O11
MSNQFKSEEERRQWEQFQAFQNQQNQQNQQYGQKKSKKGWFWGCGGCLVLFILIIIGISACTAGVTGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETAPVEPMPQSKPTTSEASPSQNIHNEDSMNDASTE

SEQ ID NO: 33443 - protein, 119 aa, Staphylococcus aureus O11
VPSEPETPTPPTPEVPSEPETPTPPTPEVPAEPGKPLPPAKEEPKKPSKPVEQGKVVTPFIEINERVKAVAPTKQKQSKKSELPETGGEESTNKGMLFGGLFSILGLALLRRNKKKHKA

SEQ ID NO: 33444 - protein, 808 aa, Staphylococcus aureus O11
MSMTYRTKKWQKLSTITLLMAGVITLNGGEFRSIDKHQIAVADTNVQTPDYEKLRNTWLDVNYGYDKYDEKNYAMKKKFEATENEAEKLLKEMKTESGRTYLWDSAKDLDNKSADMTRTYRNIEKIAEAMKHKDTKLNTPDNKNKVKDALEWLHKNAYGKEPVKKLEELKTNFSKSAPQKNTNLNWWDYEIGTPRALTNNLILLNDQFSNEEKKKYTAPIKTFAPDSDKILSSVGQPEQAKGGNLVDIAKVKLLESIIEEDKDMTKNSIDSFNKVFTYVQSNATGKERNGFYKDGSYIDHQDVPYTGAYGVVLLEGISQMMPMIKETPFNDSNQNDTTLKSWIDDGFMPLIYKSEMMDLSRGRAISRENETSHSASATVMKSLLRLSDAMDDSTKAKYKKIVKTSVKSDSTYKQNDYLSFYSDISKMKSLMEDSTISTNGLTQQLKIYNDMDRVTYHNKDLDFAFGLSMTSKNVARYESINNENLKGWHTGAGMSYLYNSDVKHYRDNFWATADMKRLAGTTTLDNEEPKENKKSDKTFVGGTKFDDQHASIGMDFENQDKTLTAKKSYFILNDKIVFLGTGIKSTDSSKNPVTTIENRKANGYTMYNDDTQTTNSDNQETNSVFLESTDAKKNIGYHFLNKSKITVKKESHTGKWSDINKSQKDTQKTDEYYEVTQKHSDKDDKYGYVLYPGITKDNFKSKASQVTIIQQEDDFHVVKDNESVWAGVNYSNSTQTFDINNTKVEVKAKGMFILKKKDDNTYECSFYNPESTNSVSDIESKISMTGYSITNKNTSTTNESSVRFELTK

SEQ ID NO: 33445 - protein, 434 aa, Staphylococcus aureus O11 [sequence omitted]

SEQ ID NO: 33446 - protein, 668 aa, Staphylococcus aureus O11
MNMKKKEKHAIRKKSIGVASVLVGTLIGFGLLSSKEADASENSVTQSDSASNESKSNDSSSVNAAPKTDNTNVSDTKTTSNTNNGETSVAQNPAQQETTQSASTNAEELVNQTSNETTSNDTNTVSSVNSPQNSTNAENVSTTQDTSTEATPSNNESAPQSTDASNKDVVNQAVNTSAPRMRAFSLAAVAADATAAGKDITNQLTNVTVGIDSGDTVYPHQAGYVKLNYGFSVPNEAVQGDTFKITVPKELNLNGVTSTAKVPPIMAGDKVLANGVIDSDGNVIYTFTDYVDTKENVTANITMPAYIDPENVTKTGNVTLATGIGSTTANKTVLVDYEKYGKFYNLSIKGTIDQIDKTNNTYRQTIYVNPSGDNVIVPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSNSDSASDSDSASDSDSASDSDSASDSDSDSDSDSDSDSDSDSDSDSDSDSDSDSDSDSDSDSDSDPDSDSDSDSDSDSDSDSDSDSDSDSDSDSDSDSDSDSDSDSDSDSD

SEQ ID NO: 33447 - protein, 327 aa, Staphylococcus aureus O11
MKMKKLVKSSVASSIALLLLSNTVDAAQHITPVNEKKVDDKITLYKTTATSDNDKLNISQILTFNFIKDKSYDKDTLVLKAAGNINSGYKKPNPRDYDYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 33448 - protein, 306 aa, Staphylococcus aureus O11
MLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLSTKDPYVSLINYLPKNKIETTDVGQTLGYNIGGNFQSAPSIGGNGSFNYSKTISYTQKSYVSEVDKQNSKSVKWGVKANAFVTPDGKKSAHDRYLFVQSPNGPSGSAREYFVPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 33449 - protein, 250 aa, Staphylococcus aureus O11
MGEFKVKYLTGFILILLLEGIFTNSASAIEYSDLHHKSKLDSKRLSNAKMSFINPTQLENKNTNDRLLKHDLLFHDMFVNDASKKDFKVEFENEALSNEFINKNIDIYAGSYSYECHGGESNKTQCSYGGVTLSDNNKYDDDKNIPCNLWIDGHQTEIKLTAVKTKKKIVTIQELDVQLRNYLNEKYKLYEQGGDIVKGYVKYHNDVEKNVEYDFYNLNGEYGHEVLKMYADNKTINSDKLHLDIYLFKS

SEQ ID NO: 33450 - protein, 232 aa, Staphylococcus aureus O11
MKFTALAKATLALGILTTGVITADSQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKKIKNIEVNLN

SEQ ID NO: 33451 - protein, 234 aa, Staphylococcus aureus O11
MNMKFTAIAKAIFILGILTTSVMITENQSVNAKGKYEKMNRLYDTNKLHQYYSGPSYELTNVSGQSQSYYDSNVLLFNQQNQKFQVFLLGKDENKFKEKTHSLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVISSEQIKNIEVNLK

SEQ ID NO: 33452 - protein, 239 aa, Staphylococcus aureus O11
MEHTTMKMTAIAKASLALGILATGTITSTHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPKFVIKKEVDAGVYTHVKRHYIYKEEISLKELDFKLRQYLIQNFDLYKKFPKDSKIKVIMKDGGYYTFELNKKLQTNRMSDVIDGRNIEKIEANIR

SEQ ID NO: 33453 - protein, 250 aa, Staphylococcus aureus O11
ATTPSSTKVEAPQQAANATTPPSTKVEAPKQTPNAPTPPSTKVEAPQSPTTKQVPTEINPKFKNLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQEDRMADVIDGTNIDNIEVNIK

SEQ ID NO: 33454 - protein, 869 aa, Staphylococcus aureus O11
MISNRLNKFSIRKYTVGTASILVGTTLIFGLGNQEAKAAENTSTENAKQDDATTSDNKEVVSETENNSTTENNSTNPIKKETNTDSQPEDKEESTTSSTQQQQNNVTATTETKPQNIEKENVKPSTDKTATEDTSVILEEKKAPNNTNNDVTTKPSTSETQTKPTTPQESTNIENSQPQPTPSKVDNQVTDATDPKEPVNVSKEELKNNPEKLKELVRNDSNTDRSTKPVVTAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSG

SEQ ID NO: 33455 - protein, 145 aa, Staphylococcus aureus O11
DSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33456 - protein, 372 aa, Staphylococcus aureus O46; identical to SEQ ID NO: 31139

SEQ ID NO: 33457 - protein, 233 aa, Staphylococcus aureus O46; identical to SEQ ID NO: 33414

SEQ ID NO: 33458 - protein, 214 aa, Staphylococcus aureus O46; identical to SEQ ID NO: 33413

SEQ ID NO: 33459 - protein, 252 aa, Staphylococcus aureus O46
SDSDSDSDSDSDSDSDSDSDSDSDSDSDSDSDSDSDSDSDSDSDSDSDSDSDSDSDSDSDSDSDSDSESDSDSDSDSDSESDSDSDSDSDSESDSDSDSDSDSDSDSDSDSDSDSDSDSDSDSDSDSESDSDSESDSDSDSDSDSDSDSDSESDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 33460 - protein, 651 aa, Staphylococcus aureus O46; identical to SEQ ID NO: 33417

SEQ ID NO: 33461 - protein, 681 aa, Staphylococcus aureus O46; identical to SEQ ID NO: 33425

SEQ ID NO: 33462 - protein, 620 aa, Staphylococcus aureus O46
MKKRIDYLSNKQNKYSIRRFTVGTTSVIVGATILFGIGNHQAQASEQSNDTTQSSKNNASADSEKNNTIETPQLNTTANDTSDISANTNSANVDRTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPIVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNEKENINGQFSLPLFTDRAKAPKSGTYPANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPKDPTPGPPVDPEPEPEPSPEPDPDSDSDSDSDSDSDSGSDSDSGSDSDSDSDSNSDSDSESDSDSDSDSDSESDSDS

SEQ ID NO: 33463 - protein, 464 aa, Staphylococcus aureus O46
MMTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDSNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33464 - protein, 224 aa, Staphylococcus aureus O46
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMQSSNHQMMSPKANMHSSNHQMNQSNKKVLPAAGESMTSSILTAGIAALLLVSGLFLAFRRRSTNK

SEQ ID NO: 33465 - protein, 1119 aa, Staphylococcus aureus O46
MISNRLNKFSIRKYTVGTASILVGTTLIFGLGNQEAKAAENTSTENAKQDDATTSDNKEVVSETENNSTTENNSTNPIKKETNTDSQPEDKEESTTSSTQQQQNNVTATTETKPQNIEKENVKPSTDKTATEDTSVILEEKKAPNNTNNDVTTKPSTSETQTKPTTPQESTNIENSQPQPTPSKVDNQVTDATDPKEPVNVSKEELKNNPEKLKELVRNDSNTDRSTKPVVTAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33466 - protein, 796 aa, Staphylococcus aureus O46
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFSNIDIAIDKGHVNSTTGKTEFWATSSDVLKLKANYKIDDSVKEGDTFTFKYGQYFRPDSVRLPSQTQNLYNAQGNIIAKGIYDSTTNTTTYTFTNYVDQYTNVSGSFEQVAFAKRENATTDKTAYKMEVNLGNDTYSEEVIVDYGNKKAQPLISSTNYINNEDLSRNMTAYVNQPKNTYTKQTFVTNLTGYKFNPNAKNFKIYEVTDQNQFVDSFTPDTSKLKDVTGQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNWTLDSGFYKTPKYSLGDYVWYDSNKDGKQDSTEKGIKDVKVTLLNEKGEVIGTTKTDENGKYRFDNLDSGKYKVIFEKPAGLTQTGTNTTKDDKDADGGEVDVTITDHDDFTLDNGYFEEETSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33467 - protein, 331 aa, Staphylococcus aureus O46
MMVKKTKSNSLKKVATLALANLLLVGALTDNSAKAEPKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGTGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33468 - protein, 338 aa, Staphylococcus aureus O46; identical to SEQ ID NO: 33421

SEQ ID NO: 33469 - protein, 351 aa, Staphylococcus aureus O46; identical to SEQ ID NO: 33422

SEQ ID NO: 33470 - protein, 898 aa, Staphylococcus aureus O46
MNKHHPKLRSFYSIRKSTLGVASVIVSTLFLITSQHQAQAAENTNTSDKISENQNNNATTTQPPKDTNQTQPATQPANTAKNYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDEPETNYDYTKLVFAKPIYNDPSLVKSDTNDAVTTNDQSSSDASNQTNTNTSNQNTSNQNTSTTNNANNQPQATTDMSQPAQPKSSANTDQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYIPDKAVYNAIVKVVVANIGYEGQYHVRIINQDIKTKDDDTSQNNTSEPLNVQTGQEDNVTATDTATNNSIETTPSEATDKVDLIEPESDMVKDTDSSVDKDAHHDVDHLSDMSGNTHFDKYDLKEMDTQIAKDTDKGVDNSVGMSSNVDTDKDSNKNKDKVIQLAHIADKNKVNNTGTETNIDTMKYHPISTIKVTDKKTTEHLPSDIHKTVDKTVKTKEKAGTPSKENKLSQSKMLPKTGETTSSQSWWGLYALLGMLTLFIPKFRKESK

SEQ ID NO: 33471 - protein, 234 aa, Staphylococcus aureus O46
MLEGIFTNSASAIEYSDLHHKSKLDSKRLSNAKMSFINPTQLENKNTNDRLLKHDLLFHDMFVNDASKKDFKVEFENEALSNEFINKNIDIYAGSYSYECHGGESNKTQCSYGGVTLSDNNKYDDDKNIPCNLWIDGHQTEIKLTAVKTKKKIVTIQELDVQLRNYLNEKYKLYEQGGDIVKGYVKYHNDVEKNVEYDFYNLNGEYGHEVLKMYADNKTINSDKLHLDIYLFKS

SEQ ID NO: 33472 - protein, 291 aa, Staphylococcus aureus O46; identical to SEQ ID NO: 30390

SEQ ID NO: 33473 - protein, 141 aa, Staphylococcus aureus O46; identical to SEQ ID NO: 31189

SEQ ID NO: 33474 - protein, 251 aa, Staphylococcus aureus O46; identical to SEQ ID NO: 33419

SEQ ID NO: 33475 - protein, 315 aa, Staphylococcus aureus O46; identical to SEQ ID NO: 30573

SEQ ID NO: 33476 - protein, 321 aa, Staphylococcus aureus O46
MNLKLNRKKVISMIKNKILTATLAVGLIAPLANPFIEISRAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSDFEITYGRNMDATYAYVTRHRLAVDRKHDAFKNRNVTVKYEVNWKTHEVKIKSITPK

SEQ ID NO: 33477 - protein, 227 aa, Staphylococcus aureus O46
MKFTALAKATLALGILTTGTLTTEAHSSHAKQNQETVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 33478 - protein, 232 aa, Staphylococcus aureus O46; identical to SEQ ID NO: 33450

SEQ ID NO: 33479 - protein, 234 aa, Staphylococcus aureus O46; identical to SEQ ID NO: 33451

SEQ ID NO: 33480 - protein, 239 aa, Staphylococcus aureus O46; identical to SEQ ID NO: 33452

SEQ ID NO: 33481 - protein, 284 aa, Staphylococcus aureus O46
MEHTTMKITTIAKTSLALGLLTTGVITTTTQAANATTPSSTKVEAPQQAANATTPPSTKVEAPKQTPNAPTPPSTKVEAPQSPTTKQVPTEINPKFKNLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQEDRMADVIDGTNIDNIEVNIK

SEQ ID NO: 33482 - protein, 369 aa, Staphylococcus aureus O46; identical to SEQ ID NO: 33434

SEQ ID NO: 33483 - protein, 231 aa, Staphylococcus aureus O46
MKMKNIAKISLLLGILATGVNTTTEKPVHAEKKPIVISENSKKLKAYYNQPSIEYKNVTGYISFIQPSIKFMNIIDGNSVNNIALIGKDKQHYYTGVHRNLNIFYVNEDKRFEGAKYSIGGITSANDKAVDLIAEARVIKEDHTGKYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 33484 - protein, 226 aa, Staphylococcus aureus O46
MKFKAIAKASLALGMLATGVITSNIQSVQAKTEVKQQSEADLKHYYNKPILERKNVTGYGFTDKGQHYLEVTVGQQHSLITLLTSDKDKYNKDVNSNIDVFILREGDSRQATNYSIGGITKSNSVQYIDYINTPILEIKKGNEDVLKDFYYISKEDISLKELDYRLRERAIKQHGLYSNGLKQGQITITMNDGTTHTIDLSQKLEKERMGESIDGRQIQKILVEIK

SEQ ID NO: 33485 - protein, 203 aa, Staphylococcus aureus O46; identical to SEQ ID NO: 30343

SEQ ID NO: 33486 - protein, 231 aa, Staphylococcus aureus O46; identical to SEQ ID NO: 33433

SEQ ID NO: 33487 - protein, 2483 aa, Staphylococcus aureus O46
MNLFRQQKFSIRKFNVGIFSALIATVTFISTNPTTASAAEQNQPAQNQPAQPADANTQPNANAGAQANPTAQPAAPANQGQPAAQPAAQPANQGGQANPAGGAAQPNTQPAGQGNQADPNNAAQAQPGNQAAPANQAGQGNNQATPANQTQPANAPAVAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLDQDVITPTVKPQAKQDIIQAVTTRKQQIKKSNASLQDEKDVANDKIGKIETKAIKDIDAATTNAQVEAIKTKAINDINQTAPATTAKAAALEEFDEVDQAQIDQAPLNPDTTNEEVAEAIERINAAKVSGVKAIEATTTAQDLERVKNEEISKIENITDSTQTKMDAYNEVKQAATARKAQNATVSNTTNEEVAEADAAVEAAQKQGLHDIQVVKSKQEVAETKSKVLDKINAIQTHAKVKPAADTEVENAYNTRKQEIQNSNASTTEEKQAAYTELDTKKQEARTNLDAANSNSEVATAKDNGITAINQVQAATTKKSDAKAEIAQKASERKTAIEAMNDSTTEEQQAAKDKVDQAVVTANTDIDNAAANTDVDNAKTTNEATIAAITPDANVKPTAKQAIADKVQAQETAIDANNGETTEEKATAKQQVQTEKTTADTAIDGAHSNAEVEAAKNAEIAKIEAIQPATTTKDDAKQAITTKANERKTAIAQTQDITAEEIAAANANVDNAVTQANSNIEAANSQNDVEQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQVAPTSVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADVQGITADTTIKDVAKDELATKAKEQKALIAQTADATTEEKEQANQQVDAELTQGNQNIENAQSIDDVNTAKDNAIQAIDPILASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQVIDAKAEETKESIDQSDQLTAEEKTEALAMIKQITDQAKKGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNANADTSSTTTNNQNDAATGGTTATSTNNPSTDDANDKPQANNNSSADASTNSPTMDNDVTSKPEVESTNNGTTDKPATETDNATPAESTINNNSTTTATNENAPTGSTATAPTTASTEAASSADSKDNAAVNDSKQNAEVNNSAESQSTNGKVAQPKSENKAKAEKDGRDSTNQSMVESTTETLPSADITEPKVSSNTEKDKKESTTNQTDAEQHNSDTNVTSNEVVKSPSKADTDVSNKPSTSKPSEAKDKMTSTNVSQTDDTATADTNDTQKSVGSAANNKVKDMQTNDMKAPLATVSKGSNSANQDMLKVTNTDKHQAKATSAQQGKVNKPKQQAKTLPDTGMSHNDDLPYAELALGAGMAFLIRRFTKKDQQTEE

SEQ ID NO: 33488 - protein, 105 aa, Staphylococcus aureus O46
PAAKPSDKTYNLFVQYKDKLQTIIGAHKIYQGNKPVLTLKEIDFRAREALIKNNILYKENRNKGKLKITGGGNNYTIDLSKRLHSDLANVYVKNPNKITVDVLFD

SEQ ID NO: 33489 - protein, 322 aa, Staphylococcus aureus O46; identical to SEQ ID NO: 33409

SEQ ID NO: 33490 - protein, 165 aa, Staphylococcus aureus O46; identical to SEQ ID NO: 31315

SEQ ID NO: 33491 - protein, 109 aa, Staphylococcus aureus O46
MKKNFIGKSILSIAAISITVSTFAGESHAQTKNAETVKKYNEYQTNLKKQVNKKVVDAQKAVNLFKRTRTVATHRKAQRAVNLIHFQHSYEKKKLQRQIDLVLKYNTLK

SEQ ID NO: 33492 - protein, 354 aa, Staphylococcus aureus O46; identical to SEQ ID NO: 33411

SEQ ID NO: 33493 - protein, 644 aa, Staphylococcus aureus O46
MNKQQKEFKSFYSIRKSSLGVASVAISTLLLLMSNGEAQAAEETGGTNTEAQPKTEAVASPSTTTEKAPEAKSVANAVSVSNKEVESPTSETKEAKEVKEVKAPKETKEVKPAAKSDNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSPSVEKENDASSESGKDKTPATKPAKAEVESSSTTPTKVVSTTQNVAKPTTASSEKTIDVVQTSAGSSEAKDSAPLQKANIKNTNDGHTQSQNNKNTQENKAKSLPQTGEESNKDMTLPLMALLALSSIVAFVLPRKRKN

SEQ ID NO: 33494 - protein, 241 aa, Staphylococcus aureus O46; identical to SEQ ID NO: 33402

SEQ ID NO: 33495 - protein, 241 aa, Staphylococcus aureus O46; identical to SEQ ID NO: 33403

SEQ ID NO: 33496 - protein, 231 aa, Staphylococcus aureus O46; identical to SEQ ID NO: 33438

SEQ ID NO: 33497 - protein, 2696 aa, Staphylococcus aureus O46
MNYRDKIQKFSIRKYTVGTFSTVIATLVFLGFNTSQAHAAETNQPASVVKQKQQSNNEQNENRESQAQNSQNSQNGQSLSATHENEQPNISQANLVDQKVAQSSTTNDEQPASQNVNTKKDSATAVTTQPDKEESKHKQNESQYANKNGNDSRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSSYQNADSSYYVENANDGSGYPVGTYINASNKGAPYYLPTAPWNTLKASAAKEIVLMTAKQTGDGYQWVIKFNKGHAPHENMIFWFALPSDQVPVGRTDFVTVNADGTNVQWSNGVGQGANKPLPQMWPYGVNDSRSRDFKVRSRSGQVIYDWSNVHVNTLRDLARAGDYFSEAGAPAATKAIGEQTFKYINGERPTESPGASTVYTFIGAGDASYTISFKTQGPTTNKLYYAAGGRALEYNQLFMYSQLYVESTQDHQQRLDGLRQTVNRTYRIGTTKNVEVGQNNYKMKKVLESTNLNIDDFIDDPLSYVRTPSNKVLGFYPTNANTNAFRPGGAQQLNEYQLSQLFTDQKLQEAARTRNPIRLMIGFDYPDGHGNAETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHTGIKNTTITTLPNGWTSNLTKADKNNGSLSITGRVSMNQTFNSDITFKVSATDNANNTTNDSQSKHVSIHVGKISEDAHPIVLGNTEKVVVVNPTAVSNDEKQSIITAFMNKNQNIRGYLASTNPVTVDNNGNVTLHYRDGSSTTLDATNVMTYEPIVKPEYQTTNAPKTATVTIAKGQSFNIGDIKQYFTLSNGQGIPSGTFTNITSDRTIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKAQAEAGGRPNYRTTGYSQANASSDGQRQYTLNGQVIQILDIINPSNGYGGQPVTNSNTRANHSNATVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPTTSQITGTVDNNHQHVSATAPNVTSATTKTINLLATNTSGNTATTSFNVTVKPLRDKYRVGTSSTAANPVRIANISNNATVSQADQTAIINSLTFTSNAPNRNYATASANEITSKTVSNVSRTGNNANVTVTVTYQDGTTSTVTVPVKHVIPEIVAHSHYTVQGQDFPAGNGSSASDYFKLSNGSAIPDATITWVSGQAPNKDNTRIGQDINVTAHILIDGETTPITKTATYKVVSSVPKHVFETNRGAVFPGVSDVYDAKQYVKPVNDSWTQNAQRMNFQFTNSYGPSKDVVGISTRDIRVTYDNHQTQIIKILAKVKPDPPRIDGNSVTYKAGLTNQQIKINNVLSSSSIKLFKADNTPLTITNTTYGSGNTAVVTVSDALPNGVIKARSSITMNNVTYTTQDEHGRAIDVTRNESVDSNDSATVTVTPQLQATTEGAVFIKGGDGFDFGHVERFIQNPPHGATVAWHDNPDTWKNTVGNTHKTAVVTLPSGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNANGLPTDGFTYKWNNAATGTNDANWAAMNKPNAAKVVNAKYDVIYNGCTFATSLPAKFVVKDVQPAKPTVTETAAGAITIAPGANQTVNTHAGNVTTYADKLVIKRNGNVVTTFTRHNNTSPWVKEASAATVAGIAGTNNGITVAAGTFNPADTIQVVATQGSGETVSDEQRSDDFTVVAPQPNQATTKIWQNGHIDITPNNPSGHLINPTQAMDIAYTEKVGNGAEHSKTINVVRGQNNQWTIANKPDYVTLDAQTGKVTFNANTIKPNSAITITPKAGTGHSASSNPSTLTAPATHTVNTTEIVKDYGSNVTAAEINNAVQVANKRTATIKNGTAMPTNLAGGSTTTIPVTVTYNDGSTEEVQESIFTKADKRELITAKNHLDDPVSTDGKKPGTITQYNNAIHNAQQQINTAKTEAQQVINNERATPQQVSDALTKVRAAQTKIDQAKALLQNKEDNSQLVTSKNNLQSSVNQVPSTAGMTQQSIDNYNAKKREAESEITAAQRVIDNGDATAQQISDEKHRVDNALTALNQAKQNLTADTHALEQAVQQ

SEQ ID NO: 33498 - protein, 225 aa, Staphylococcus aureus O46
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPAPIQPSASPAQNNNHSDANSTATETVSNANNNDVVSNNTTLNVPNRTNENGSGGHLTLKEIQEDVRHSSDKPELVAIAEQASNRPKKRSRRAAPADPNATPADPAAAAAGNGGAPVAITAPY

SEQ ID NO: 33499 - protein, 434 aa, Staphylococcus aureus O46 [sequence omitted]

SEQ ID NO: 33500 - protein, 1001 aa, Staphylococcus aureus O46
MNMKKKEKHAIRKKSIGVASVLVGTLIGFGLLSSKEADASENSVTQSDSASNESKSSDSSSVNAAPKTDNTNVSDTKTTSNTNNGETSVAQNPAQQETTQSASTNATTEETPVTGEATTTATKQANTPATTQSSNTNAEELVNQTSNETASNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVMANGVIDSDGNVIYTFTDYVDTKENVTANITMPAYIDPENVTKTGNVTLTTGIGTNTASKTVLIDYEKYGQFHNLSITGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSDSDSASDSDSASDSDSASDSDSTSDSDSASDSDSASDSDSTSDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSASDSDSGSDSGSSSDSDSDSASDSTSDTESDNDSDSESDSNSDSDSGSNNNVVPPNSPKNGTNASNKNEAKDSKEPLPDTGSEGEANTSLIWGLLASLGSLLLFRRKKENKDKK

SEQ ID NO: 33501 - protein, 331 aa, Staphylococcus aureus O46
MSNQFKSEEERRQWEQFQAFQNQQNQQNQQYGQKKSKKGWFWGCGGCLVLFILIIIGISACTAGVTGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNTSKSDKSSVEKSESNEETAPVEPMPQSKPTTSEASPSQNIHNEDSMNDASTE

SEQ ID NO: 33502 - protein, 808 aa, Staphylococcus aureus O46
MSMTYRTKKWQKLSTITLLMAGVITLNGGEFRSIDKHQIAVADTNVQTPDYEKLRNTWLDVNYGYDKYDEKNDAMKKKFEATENEAEKLLKEMKTESGRTYLWDSAKDLDNKSADMTRTYRNIEKIAEAMKHKDTKLNTPDNKNKVKDALEWLHKNAYGKEPVKKLEELKTNFSKSAPQKNTNLNWWDYEIGTPRALTNTLILLNDQFSNEEKKKYTAPIKTFAPDSDKILSSVGQPEQAKGGNLVDIAKVKLLESIIEEDKDMTKNSIDSFNKVFTYVQSNATGKERNGFYKDGSYIDHQDVPYTGAYGVVLLEGISQMMPMIKETPFNDSNQNDTTLKSWIDDGFMPLIYKSEMMDLSRGRAISRENETSHSASATVMKSLLRLSDAMDDSTKAKYKKIVKTSVKSDSTYKQNDYLSSYSDISKMKSLMEDSTISTNGLTQQLKIYNDMDRVTYHNKDLDFAFGLSMTSKNVARYESINNENLKGWHTGAGMSYLYNSDVKHYRDNFWATADMKRLAGTTTLDNEEPKENKKSDKTFVGGTKFDDQHASIGMDFENQDKTLTAKKSYFILNDKIVFLGTGIKSTDSSKNPVTTIENRKANGYTMYNDDTQTTNSDNQETNSVFLESTDAKKNIGYHFLNKSKITVKKESHTGKWSDINKSQKDTQKTDEYYEVTQKHSDKDDKYGYVLYPGITKDNFKSKASQVTIIQQEDDFHVVKDNESVWAGVNYSNSTQTFDINNTKVEVKAKGMFILKKKDDNTYECSFYNPESTNSVSDIESKISMTGYSITNKNTSTTNESSVRFELTK

SEQ ID NO: 33503 - protein, 116 aa, Staphylococcus aureus O46
EPETPTPPTPEVPSEPETPTPPTPEVPAEPGKPLPPAKEEPKKPSKPVEQGKVVTPVIEINERVKAVAPTKQKQSKKSELPETGGEESTNKGMLFGGLFSILGLALLRRNKKNNKA

SEQ ID NO: 33504 - protein, 971 aa, Staphylococcus aureus O46
MIVVGMGQEKEAAASEQNNTTVEESGNSATESKASETQTTTNNVNTIDETQSYSATSTEQPSQSTQVTTEEAPTTVQAPKVETSRVDLPSEKVADKKTTGTQVDTAQQSNVSEIKPRVKRSADVAAVAEKEVVEEAKVTGTDVTSKVKVTESSLEGHEQGTNVVNPHNAERVTLKYKWNFGEGIKAGDYFDFTLSNNVETHGISTLRKVPEIKSSSDNQIMANGQVIDERKIRYTFTDYINSKKDLTAELTLNLFIDSTTVTKQGSQKVEVTLGQNKVSKEFDIKYLDGVKDRMGVTVNGRIDTLNKEDGKFSHFAYVKPNNQSLSSVTVTGQVTSGYKQNANNPTVKVYKHIGSDELAESVYGDLENTMKFQDVTGEVTLQYTDNGGYSLNFNNLDQSKNYVIKYEGDYDSNTNALEFQTHLLGYYSYYYYNTSNLTWKNGVAFYSNKAQGDGKDKPNDPIIEKSEPIELDIKSEPPVEKHELTGTIEESNDSKPIDFEYHTAVEGSEGHAEGIVETEEDSIHVDFEESTHENSKHHADVLEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEENTEEDKPKYEQGGNIVDIDFDSVPQIQGQNNGNQSFEEDTEKDKPKYEQGGNIIDIDFDSVPHIHGFNKHNEIIEEDTNKDKPNYQFGGHNSVDFEEDTLPKVSGQNEGQQTIEEDTTPPTPPTPEVPSEPGEPTPPTPEVPSEPETPTPPTPEVPSEPETPTPPTPEVPSEPDTPTPPTPEVPSEPGEPTPPTPEVPSEPGTPTPPTPEVPTEPGKPVPPAKEEPKNPSKPVEQGKVVTPVIEINEKVKAVAPTKQKQYKKSELPETGGEESTNKGMLFGGLFSILGLALLRRNKKKHKA

SEQ ID NO: 33505 - protein, 29 aa, Staphylococcus aureus O46
MISMAQDIISTIGDLVKWIIDTVNKFTKK

SEQ ID NO: 33506 - protein, 311 aa, Staphylococcus aureus O46
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLSTKDPYVSLINYLPKNKIETTDVGQTLGYNIGGNFQSAPSIGGNGSFNYSKTISYTQKSYVSEVDKQNSKSVKWGVKANAFVTPDGKKSAHDRYLFVQSPNGPSGSAREYFVPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 33507 - protein, 327 aa, Staphylococcus aureus O46; identical to SEQ ID NO: 33447

SEQ ID NO: 33508 - protein, 308 aa, Staphylococcus aureus O46; identical to SEQ ID NO: 33439

SEQ ID NO: 33509 - protein, 322 aa, Staphylococcus aureus O46
MKFKNIVKSSVATSITLIMLSNTVDAAQHITPVSEKKVDDKITLYKTTATSDSDKLKISQILTFNFIKDKSYDKDTLILKAAGNIYSGYTQPTSDSSINSQFYWGAKYNVFVSSESKDSVNIVDYAPKNQNEEFQVQQTLGYSYGGDINIINGLTGGLNGSKSFSETINYKQESYRTTIDRKTNHKSIGWGVEAHKIMNNGWGPYGRDSSDSLYGNELFLGGRQSSSNANQNFLPTHQMPILARGNFNPEFISVLSHKQKDVKKSKIKVTYQREMDRYENFWNNLHWIGYNFKNQKRATHTSIYEIDWEKHTVKLVASQSSE

SEQ ID NO: 33510 - protein, 165 aa, Staphylococcus aureus; identical to SEQ ID NO: 31315
  subsp. anaerobius

SEQ ID NO: 33511 - protein, 520 aa, Staphylococcus aureus
  subsp. aureus
MLTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNNKPGKEDNNKPGKEDGNKPGKEDNKKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33512 - protein, 1006 aa, Staphylococcus aureus
  subsp. aureus
ASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESEIEAPKGNNVQPHEGQRVVLKYKLKFQDGLNTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDGVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPSTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 33513 - protein, 165 aa, Staphylococcus aureus; identical to SEQ ID NO: 32831
  subsp. aureus

SEQ ID NO: 33514 - protein, 155 aa, Staphylococcus aureus; identical to SEQ ID NO: 30258
  subsp. aureus

SEQ ID NO: 33515 - protein, 177 aa, Staphylococcus aureus
  subsp. aureus
LVFSKDNSTVTAEFKNVEDVKKFKNRAVDVYGLSYSGYCLKNKYMYGGVTLAGDYLEKSRCIPINLWVNGNHKTISTDKVSTNKKIVTAQEIDTKLRRYLQEEYNIYGFNDTNKGRNYGTKSKFFSGFNTGKISFHLNDGTSFSYDLFDTGTGQAESFLKIYNDNKTVETDKFHLDV

SEQ ID NO: 33516 - protein, 163 aa, Staphylococcus aureus
  subsp. aureus
QFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYEDNKTVESEKFHLD

SEQ ID NO: 33517 - protein, 154 aa, Staphylococcus aureus
  subsp. aureus
ATNKYKGKKVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNKTINSENLHIDLY

SEQ ID NO: 33518 - protein, 159 aa, Staphylococcus aureus
  subsp. aureus
DKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVY

SEQ ID NO: 33519 - protein, 286 aa, Staphylococcus aureus
  subsp. aureus
ANDTEDIGKGNDVEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKEKGQN

SEQ ID NO: 33520 - protein, 286 aa, Staphylococcus aureus
  subsp. aureus
ANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKEKGQN

SEQ ID NO: 33521 - protein, 250 aa, Staphylococcus aureus
  subsp. aureus
  strain ED133
MGEFEVKYLTGFILILLLEGILTNSASAIEYSDLHHKSKLNSKRLSNAKMSFINPTQLENKKTNDRLLTHDLLFHDMFLNDASKKDFKVEFENEALSNEFINKNIDIYAGSYSYECHGGETNKTQCSYGGVTLSDNNKYDDYKNIPCNLWIDGHQTEIELTAVKTKKKIVTIQELDVQLRNYLSEKYKLYEKGGDIVKGYVKYHNDDEKNVEYDFYNLNGEYGHEVLKMYADNKTINSDKLHLDIYLFKS

SEQ ID NO: 33522 - protein, 291 aa, Staphylococcus aureus; identical to SEQ ID NO: 30390
  subsp. aureus
  strain ED133

SEQ ID NO: 33523 - protein, 890 aa, Staphylococcus aureus
  subsp. aureus
  strain ED133
MNKHHPKLRSFYSIRKSTLGVASVIVSTLFLITSQHQAQAAENTNTSDKISENQNNNATTTQPPKDTNQTQPATQPANTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDEPETNYDYTKLVFAKPIYNDPSLVKSDTNDALATNDQSSSDASNQTNTNTSNQNTSTTNNANNQPQATTDMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYIPDKAVYNAIVKVVVANIGYEGQYHVRIINQDIKTQDDDTSQNNTSEPLNVQTGQEDNVTATDTATNNSIETTPSEATDKVDLIEPESDMVKDTDSSVDKDAHHDVDHLSDMSGNTHFDKYDLKEMDTQIAKDTDKGVDNSVGMSSNVDTDKDSNKNKDKVIQLAHIADKNHTGKAAKLDGVRQNYNNTDKVTYKKTTEHPSNDIHKTVDKTVKTKEKAGTPSKENKLSQSKMLPKTGETTSSQSWWGLYALLGMLALFIPKFRKESK

SEQ ID NO: 33524 - protein, 2185 aa, Staphylococcus aureus
  subsp. aureus
  strain ED133
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPAPIQPSASPTQNNNHSDANSTATETVSNANNNDVVSNNTTLNVPNRTNENGSGGHLTLKEIQEDVRHSSDKPELVAIAEQASNRPKKRSRRAAPADPNATPADPAAAAANGTVPAGNTAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKTLTVNPNSELIFEFNTMSTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQRAIINATPDATEDEIQDALNQLATDETDAIDNVTNATTNTDVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLTDLATAKKQEINQNTNATTEEKQVALNQVDQELATAINNINQADTNAEVDQAQQLGTKAINAIQPNIVKKPAALAQINQHYNTKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALTKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPEHIVRAGARDAVKQQYEAKKQEIEQAEHATDEEKQVALNQLANNEKLALQNINQAVTNNDVKRVETNGIATLKGVQPHIVIKPEAQQAIKASAENQVELIKDTPHATVDELDEANQLISDTLKKAQQDIDNTTQDAAVNDVRNQTIKAIEQIKPKVRRKRAALDNIDESNNNQLDAIRNTLDTTQDERNVAIDTLNKIVNAIKNDIAQNKTNAEVDQTEADGNNNIKVILPKVQVKPAARQSVSAKAEAQNALIDQSDLSTEEERLAAKHLVEQALNQAIDQINHADKTVQVNQNSIDAQNIISKIKPATTVKATALQQIQNIATNKINLIKANNEATDEEQNAAIAQVEKELIKAKQQIASAVTNADVAYLLHDGKNEIREIEPVINRKASAREQLTTLLNDKKQAIEANIQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATAEQLAKVKALIDQYVTDGNRMIDEDATLNDIKQHTQFIVDEILAIKLPAEATKVSPKVIQSAPKVCTPIKKEETHESRKVEKELPNTGSEGMDLPLKEFALITGAALLARRRTKNEKES

SEQ ID NO: 33525 - protein, 331 aa, Staphylococcus aureus
  subsp. aureus
  strain ED133
MSNQFKSEEERRQWEQFQAFQNQQNQQNQQYRQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETAPVEPMPQSKPTTSEASPSQNIHNEDSMNDASTE

SEQ ID NO: 33526 - protein, 327 aa, Staphylococcus aureus
  subsp. aureus
  strain ED133
MKMKKLVKSSVATSIALLMLSNTVDAAQHITPVSEKKVDDKITLYKTTATSDNDKLNISQILTFNFIKDKSYDKDTLVLKAAGNVNSGYKKPNPKDYDYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 33527 - protein, 322 aa, Staphylococcus aureus; identical to SEQ ID NO: 30469
  subsp. aureus
  strain ED133

SEQ ID NO: 33528 - protein, 308 aa, Staphylococcus aureus; identical to SEQ ID NO: 33439
  subsp. aureus
  strain ED133

SEQ ID NO: 33529 - protein, 330 aa, Staphylococcus aureus; identical to SEQ ID NO: 30381
  subsp. aureus
  strain ED133

SEQ ID NO: 33530 - protein, 338 aa, Staphylococcus aureus
  subsp. aureus
  strain ED133
MIKQLYKNITICSLAISTALTVFPATSYAKINSEIKAVSEKNLDGDTKMYTRTATTSDSQKNITQSLQFNFITEPNYDKETVFIKAKGTIGSGLRILDPNGYWNSTLRWPGSYSVSIQNVDDNNHTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 33531 - protein, 351 aa, Staphylococcus aureus; identical to SEQ ID NO: 33422
  subsp. aureus
  strain ED133

SEQ ID NO: 33532 - protein, 231 aa, Staphylococcus aureus
  subsp. aureus
  strain ED133
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSANQANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 33533 - protein, 2038 aa, Staphylococcus aureus
  subsp. aureus
  strain ED133
MNLFRQQKFSIRKFNVGIFSALIATVTFISTNPTTASAAEQNQPAQNQPAQPADANTQPNANAGAQANPTAQPAAPANQGQPAAQPANQGGQANPAGGAAQPNTQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLDQDVITPTVKPQAKQDIIQAVTTRKQQIKKSNASLQDEKDVANDKIGKIETNAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNTTNEEVAEADAAVEAAQKQGLHDIQVVKSKQEVAETKSKVLDKINAIQTQAKVKPAADTEVENAYNTRKQEIQNSNASTTEEKQAAYTELDTKKQEARTNLDAANSNSEVATAKDNGITAINQVQAATTKKSDAKAEIAQKASERKTAIEAMNDSTTEEQQAAKDKVDQAVVTANADIDNAAANADVDNAKTTSEATIAAITPDANVKPTAKQAIADKVQAQETAIDVNNGATTEEKAAAKQQVQTEKTTADTAIDGAHSNAEVEAAKNAEIAKIEAIQPATTTKDDAKQAITTKANERKTAIAQTQDITAEEIAAANADVDNAVTQANSNIEAANSQNDVDQAKTNVDQSSTNEYVDNAVKEGKAKINAVKTFSEYKKDALAKIADAYNSKVNEADNSNASTSSEIAEAKQKLAELKQTADQNVNQATSKDDIEVRIHNDLDNINDYTIPTGKKETATTDLYAYADQKKNNISADTNATQDEKQQAIKQVDQNVQTALESINNGVDNGDVDDALTQGKAAIDAIQVDATVKPKANQAIEAKAEDTKESIDHSEQLTAEEKTEALATIKQITDQAKQGITDATTTAEVEKAKAQGLEAFDNIQIDSTEKQKAIEELETALDQIEVGVNVDADATTEEKEAFTNVLEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNANADTSSTTTNNQNDAATGGTTATSTNNPSTDDTNNKPTANKNSSVDASTDNSATGNGTTDKPEVESTNNGTTDKPATETDNVTPAESTTNNNSTTATNENAPTGSTATAPTTASTEAASSADSKDNASVNDSKQNAEVNNSAESQSTNGKVAQPKSENKAKAEKDGRDSTNQSMVESTTETLPSADITEPKASSNTSKDKEESTTNQTDAGQLKSETNVASNEADKSEGNVDTDVSNKPSTSKPSEAKDKATSTEDSQKADMATADTKDNQAAIGATADVNNKATQNDGANASPATVSKGSNSANQDMLNVTKTKENKTNVKSAQQGKVNKPKQQAKTLPDTGMSHNDDLPYAELALGAGMAFLIRRFTKKDQQTEE

SEQ ID NO: 33534 - protein, 524 aa, Staphylococcus aureus
  subsp. aureus
  strain ED133
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLSEAKKLNESQAPKADNTFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNNKPGKEDGNKPGKEDGNKPGKEDNNKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33535 - protein, 811 aa, Staphylococcus aureus
  subsp. aureus
  strain ED133
MTYKMKKWQKLSTITLLMAGVITLNGGEFRSIDKHQIAVADTNVQTPDYEKLRNTWLDVNYGYDKYDESNPDMKKKFEATEKEARKLLSSMKTESDRKYLWESSKDLDTKSADMTRTYRNIEKIAEAMKHKNTKLNTPDNKNKVKDALEWLHKNAYGKEPVKKLEELKTNFSKSAPQKNTNLNWWDYEIGTPRALTNTLILLNDQFSNEEKKKYTAPIKTFAPDSDKILSSVGQPEQAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQYNTTLKSWIDDGFMPLIYKGEMMDLSRGRAISRENETSHTASATVMKSLLRLSDTMDDSTKTRYKQIVKTSVESDSSYKQTDYLNSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEILKDTDDKKSSKTFVCGTKADDQHASIGMDFENQDKTLTAKKSYFILNDKIVFLGTGIKSTDSSKNPVTTIENRKANGYTLYTDDIQTSASNINDQETNSVFLESTNKPKNNIGYHFFNKPKITVTKESHTGKWKEINKSQKSEDKKDEYYEVTQKHSNTDDKYGYVLYPGITKDNFKSKASQVTVVKQDDDFHVVKDNESVWAGVNYSDSAKTFEINGTKVEVKVKGMFILKKKDDKTYECSFYNPESTNTASDIESKISMTGYSITNKNASTTNESGVCFELTK

SEQ ID NO: 33536 - protein, 141 aa, Staphylococcus aureus
  subsp. aureus
  strain ED133
MKLKSFVTATLALGLLSTVGAALPSHEASADSNNGYKELTMDGKHTVPYTISVDGITALHRTYFVFPENKKVLYQEIDSKVKNELASQRGVTTEKINNAQTANYTLTLNDGNKKVVNLKKNDDAKNSIDPSTIKQIQIVVK

SEQ ID NO: 33537 - protein, 652 aa, Staphylococcus aureus
  subsp. aureus
  strain ED133
MLRGQEERKYSIRKYSIGVVSVLAATMFVVTSHEAQASEKTPTTNAAAQKETLNQPGEQGNAITSHQMQSGKQLDDMHKENGKSGTVTEGKDTLQSSKHQSTQNSKTIRTQNDNQVKQDSERQGSRQSHQNNAINKTERQNDQVQNTHHAERNGSQSTTSQSNDVDKSQPSIPAQKVIPNHDKAAPTSTTPPSNDKTAPKSTKTQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHDNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDCLVLKTF

SEQ ID NO: 33538 - protein, 309 aa, Staphylococcus aureus
  subsp. aureus
  strain ED133
MIKNKILTATLAVGLIAPLANPFIEISKAENKIEDIGQGAEIIKRTQDIASKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 33539 - protein, 315 aa, Staphylococcus aureus; identical to SEQ ID NO: 30573
  subsp. aureus
  strain ED133

SEQ ID NO: 33540 - protein, 325 aa, Staphylococcus aureus; identical to SEQ ID NO: 30407
  subsp. aureus
  strain ED133

SEQ ID NO: 33541 - protein, 203 aa, Staphylococcus aureus
  subsp. aureus
  strain ED133
MFKKYDSKNSIVLKSILSLGIIYGGTFGIYPKADASTQNSSSVQDKQFQKVEEVPNNSEKALVKKLYDRYSQNTINGKSNKSRNWVYSERPLNENQVRIHLEGTYTVADRLYTPKRNITLNKEVVTLKELDHIIRFAHISYGLYMGEHLPKGNIVINTKNGGKYTLESHKELQKDRENVKNNTDDIKNVTFELVKSVNDIEQV

SEQ ID NO: 33542 - protein, 887 aa, Staphylococcus aureus
  subsp. aureus
  strain ED133
MIVVGMGQEKEAAASEQNNTTVEESGSSGTESKASETQTTTNNVNTIDETQSYSATSTEQPSQSTQVTTEEAPTTVQAPKVETSRVDLPSEKATDKEIAGTQVDTAQPSNVSEIKPRMKRSADVTAASEKEVVEEAKVTGTDVTNKVKVTESSLEGHKQGTNVVNPHNAERVTLKYKWSFEEGIKAGDYFDFTLSNNVETHGISTLRKVPEIKSSADNQVMANGQVINERKIRYTFTDYINNKKDLTAELNLNLFIDPTTVTKKGKQKVEVSLGQNKISQEFDIQYLDGVKDRMGVTVNGRIDTLNKAEGKFSHFAYVKPNNQSLSSVTVTGQVTSGYKQNAKNPTVKVYKHIGSDELAESVYGDLENTMKFQDVTGEVTLQYTDNGGYSLNFNNLDQSKNYVIKYEGDYDSNTNALEFQTHLLGYYNYYYYNTSNLTWKNGVAFYSNNAKGDGKDKPNDPIIEKSEPIDLNIKSEPPVEKHELTGTIEESNDSKPIDFEYHTAVEGVEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPPTPEVPTEPGKPVPPAKEEPKKPSKPVEQGKVVTPVIEINEKVKAVAPTKQKQSKKSELPETGGEESTNKGMLFGGLFSILGLALLRRNKKNDKA

SEQ ID NO: 33543 - protein, 1020 aa, Staphylococcus aureus
  subsp. aureus
  strain ED133
MIVVGMGQDKEAAASEQKTTTVEENGNSATDNKVSETQTTTTNVNTIDETQSYSATATEQPSNATQVTTEEAPKAVQAPQTAQPANVETVKEEVVKEEAKPQVKETTQSQDNSGDQRQVDLTPKKVTQNQVAETQVEVAQPRTVSESKPRVTRSADVVEAKDASDVTEVKGTDVTSKVTVESGSIEAPQGNKVEPHAGQRVVLKYKLKFEKGLHKGDYFDFTLSNNVNTYGVSTARKVPEIKNGSVVMATGQLLGNGKIRYTFTDYIDYKVNVTADLEINLFIDPKTVQSNGQQTITSTLNDKETKNTLPIEYNPGVSNSYANVNGSIETFDKGNNRFTHVAYIKPQNGHKSDSVSITGTLTQGSKANGNAPTVKVYEVLKDAKELPESVYANISDSTMFKDVTQEMKDKLKVENNGSYKLDIEKLEKSYVIHYDGEYLSGSDQVNFRTHMFGYPEQQYKYYYTHLGYQLTWDNGLVLYSNKAKGDGTNGTITESNNMTFDEEYGTGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTLPTPEVPSEPETPTPPTPEVPSEPETPTPPTPEVPSEPETPTPPTPEVPSEPGEPTPPTPEVPSEPGKPTPPTPEVPAEPGKPVPPAKEEPKNPSKPVEQGKVVTPVIEINEKVKAVAPTKQKQSKKSELPETGGEESTNKGMLFGGLFSILGLALLRRNKKNHKA

SEQ ID NO: 33544 - protein, 233 aa, Staphylococcus aureus; identical to SEQ ID NO: 30678
  subsp. aureus
  strain ED133

SEQ ID NO: 33545 - protein, 234 aa, Staphylococcus aureus
  subsp. aureus
  strain ED133
MNKKLLMKFFIVSPLLLATIATGFTPVPLSSNQIIKTAKASTNDNIKDLLDWYSSGSDAFTNSEVLDNSLGSMRIKNTDGSISLIIFPSPYYSPTFSKGEKVDLNTKRIKKSQHTSEGTWIHFQISGVTNTEKLPTPIELPLKVKVHGKDSPLKYWPKFDKKQLAISTLDFKIRHQLTQTHGLYRSSDKTGGYWKITMNDGSTYQSDLSKKFEYNTEKPPINIDEIKTIEAEIN

SEQ ID NO: 33546 - protein, 266 aa, Staphylococcus aureus
  subsp. aureus
  strain ED133
MNKSRFISCVILIFSLILVLFTPNVLAESQPDPTPDELHKASKFTGLMENMKVLYDDRYVSATKVKSVDKFLAHDLIYNISDKKLKNYDKVKTELLNEDLAKKYKDEVVDVYGSNYYVNCCFSSKDNVGKVTGGKTCMYGGITKHEGNHFDNGNLQNVLIRVYENKRNTISFEVQTDKKSVTAQELDIKARSFLINKKNLYEFNSSPYETGYIKFIENNGNTFWYDMMPAPGDKFDQSKYLMMYNDNKTVDSKSVKIEVHLTTKNG

SEQ ID NO: 33547 - protein, 240 aa, Staphylococcus aureus
  subsp. aureus
  strain ED133
MKKRLLFVIVITLFIFSSNHTVLSNGDVGPGNLRNFYTKYEYVNLKNVKDKNSPESHRLEYSYKNDTLYAEFDNEYITSDLKGKNVDVFGISYKYGYNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEISKR

SEQ ID NO: 33548 - protein, 226 aa, Staphylococcus aureus
  subsp. aureus
  strain ED133
MKFKAIAKASLALGMLATGVITSNIQPVHAKTEVKQQSEADLKLYYNGPSFEYKKVTGYGFIEGKDRFIDFIYNGQYNKISLVGSDKDKYNEEVNPDIDVFVVREGNGRQADNHSIGGVTKTNRGVYYDYIHTPILEIKKGKEEPQSSLYQIYKEDISLKELDFKLRKQLISQSGLYSNGLKQGQITITMNDGTTHTIDLSQKLEKERMGESIDGTKINKILVEIK

SEQ ID NO: 33549 - protein, 231 aa, Staphylococcus aureus; identical to SEQ ID NO: 30578
  subsp. aureus
  strain ED133

SEQ ID NO: 33550 - protein, 356 aa, Staphylococcus aureus
  subsp. aureus
  strain ED133
MKMRTIAKTSLALGLLTTGAITVTTQSVKAEKVQSTKVDKVPTLKAERLAMINITTGANTATTQAANTRQERTPKLEKAPNTNEEKTSTSKKEKISQPKQEAQKSLNISATPAPKQEQSQTTTESTTPKTKVTIPPSTNTPQPMQSTKSDTPQSPTIKQAQTVITPKYEDLRAYYMKPSFEFEKQFGFMLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKKGGKYTFELHKKLQEHRMADVIEGTNIDKIEVNIK

SEQ ID NO: 33551 - protein, 347 aa, Staphylococcus aureus
  subsp. aureus
  strain ED133
MKITTIAKTSLALGLLTTGVITTTTQAANATTPSSTKVEAPQQAANATTPSSTKVETPQQTPNATTPSSTKVEAPQQAANATTPSSTKVEAPKQTPNATTPSSTKVEAPQQAANATTPSSTKVEAPKQTPNATTPSSTKVETPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIENHNLYGNVGSGKIVIKMKNGGKYTFELHKKLQENRMADVIDATNIDNIEVNIK

SEQ ID NO: 33552 - protein, 234 aa, Staphylococcus aureus
  subsp. aureus
  strain ED133
MKMTAIAKASLALGILATGTITSTHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPKFVIKKEVDAGVYTHVKRHYIYKEEVSLKELDFKLRQYLIQNFDLYKKFPKDSKIKVIMKDGGYYTFELNKKLQTNRMSDVIDGRNIEKIEASIR

SEQ ID NO: 33553 - protein, 231 aa, Staphylococcus aureus
  subsp. aureus
  strain ED133
MKLKTLAKATLVLGLLATGVITTESQTVKAAESTQGQHNYKSLKYYYSKPSLELINVDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEVSLKELDFKLRKKLMEEEKLYGAVNNRKGKIVVKMEDDKFYTFELTKKLQPHRMGDTIDGTKIKEINVELEYK

SEQ ID NO: 33554 - protein, 231 aa, Staphylococcus aureus
  subsp. aureus
  strain ED133
MKLKTLAKATLALGLLTTGVITSEGQAVHAKEKQERVQHLYDIKDLHRYYSSESFEFSNISGKVENYNGSNVVRFNQDGQNHQLFLLGEDKAKYKQGLEGQNVFVVKELIDPNGRLSTVGGVTKKNNQSSETNTPLFVKKVYGGNLDASIESFSINKEEVSLKELDFKIRQHLVKNYDLYKGTTKYGKITFNLKDGEKKEIDLGDKLQFEHMGDELNSKDIQNIAVTINQI

SEQ ID NO: 33555 - protein, 232 aa, Staphylococcus aureus
  subsp. aureus
  strain ED133
MKFTVIAKAIFVLGILTTSAMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVISSEQIKNIEVNLK

SEQ ID NO: 33556 - protein, 232 aa, Staphylococcus aureus
  subsp. aureus
  strain ED133
MKFTALAKATLALGILTTGVFTAEGQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTADKGRIVINMKDEKKHEIDLSEKLSFERMFDVMDSKKIKNIEVNLN

SEQ ID NO: 33557 - protein, 225 aa, Staphylococcus aureus
  subsp. aureus
  strain ED133
MKFTALAKATLALGILTTGTLTTEAHSGHAKQESVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 33558 - protein, 227 aa, Staphylococcus aureus
  subsp. aureus
  strain ED133
MKLKNIAKASLALGILTTGMITTTAQPVKASTLEARSQATQDLKDYYKGQSFDLKNIGGYKEGNKVTFIYHNQQIDVTLTGKEKLEFNDDEEISNVDVFVVRENSDRSGITNSNGGITYSNKQDNIDNVKSVNMQITKKTSSNTETVTSSYYSIDKENISLKELDFKLRKHLIDNNGLYNTEPKDSKIKVTMKDGGFYTFELNKKLQTHRMGDVIDGRNIEKIEVNL

SEQ ID NO: 33559 - protein, 211 aa, Staphylococcus aureus
  subsp. aureus
  strain ED133
MKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDVHTKSNKQMAKQQSIHLDSKSKSGHKQQLKELPKTGVNNESNTAIMALFIGLILLVVSLVTRFIKLNSYK

SEQ ID NO: 33560 - protein, 909 aa, Staphylococcus aureus
  subsp. aureus
  strain ED133
MKKRIDYLSNKQNKYSIRRFTVGTTSVIVGATILFGIGNHQAQASEQSNDTTQSSKNNASADSEKNNTIETPQLNTTANDTSDISANTNSANVDRTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNDKVTAKDLQLQKTTFDPNQSGNTFMAANFTVTDKVKSGDYFTAKLPESLTGNGDVDYSNSNNTMPIADIVNDKNEVVAKATYDILTKTYTFVFTDYVNDKQNINGKFSLPLFTDRAKAPKSGTYDANINIADEMFNNQITYNYSSPIAGIDKPNGANISSQIIGVDTASGQNTYKQTVFVNPKQRVLGNAWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVNPKDPTPGPPVDPEPSPEPEPSPEPEPEPTPDPEPEPDSDSDSDSGSDSDSGSDSDSDSDSNSDSDSESDSDSNSDSDSESDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSESDSDSESDSDSDSDSDSESDSDSDSDSDSDSDSDSDSDSDSDSDSDSDSDSDSDSDSDSDSDSDSESDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 33561 - protein, 2232 aa, Staphylococcus aureus
  subsp. aureus
  strain ED133
MSKRQKEFHDSLANEKTRVRLYKSGKNWVKSGIKEIEMFKIMGLPFISHSMVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVTSTSSTEQPINTSTNQSTASNNTSQSTTPTSANLNKTSTTSTSTAPVKLRTFSRLAMSTFASAATTTALTANTITVNKDNLKQYMTTSGNATYDQSTGVVTLTQDTTSQKGAITLGTRIDSNKSFHFSGKVNLGNKYEGHGNGGDGIGFAFSPGVLGETGLNGAAVGIGGLSNAFGFKLDTYHNTSTPNSSAKAKADPSNVAGGGAFGAFVTTDSYGVASTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPINIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSASTSKSTSVSLSDSVSASKSLSTSESNSVSSSTSTSLVNSQSVSSSMSGSVSKSTSLSDSISNSSSTEKSESVSTSTSDSLLTSTSLSDSVSMSTSGSLSKSQSLSTSTSDSASTSQSVSDSTSNSISTSESLSESGSTSESISISNSISNSVSASTSKSESQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSSSVRMSESQSTSGSMSTSQSDSTSISTSFSDSTSDSKSASTASSESISQSVSTSTSGSVSTSTSLSTSNSERTSTSMSDSTSLSTSESDSISESTSTSDSISEAISASESTSISLSESNSISDSESQSASAFLSESLSVSTSESTSESVSSSTSASTSLSDSTSESGSTSTSLSNSTSGSSSISTSTSNSESTSTFKSESVSTSLSTSTSTSLSDSTSLSTSLSDSTSGSKSDSLSTSMLTSDSISTSKSDSISTSTSLSGSTSESESDSTSSSESKSDSTSMSISMSQSTSGSTSTSTSTSLSDSTSTSLSLSASMNQSGVDSNSESQSVSASTSISTSESDSLSTSSYTSQSGSTSESTSTSTSLSDSTSISKSTSQSGSTSTSASLSGSESESDSQSTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSASLSGSESVSESSSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISSSISVSDSSSASTSESLSDSMAQSQSTSTSASGSLSTSISLSMSASASTSTSQSTSVSTSLSTSDSISDSTSISISGSQSAVESESTSDSTSISDSESLSTSGSTSGSTSISTYESLSMSGSTHNSTSVSDSDSISTSNSGSMSNSIRHFTSLSTSGLMSLSDSNSMSDSDSVSMSNSTSTSMSDSTSMSDSESVSTSASTSLSTSNSESASVSMSDSTSTSMSNSTSMSDSDSVSISASESMSASMSDSVSISDSTSSSMSNSMSMSTSESNSIHPSNSMSTSQTHFTSTSISTSESIAPNTNESQSTLSATSVSSKHDAEPAQSEERLPDTGDSIKQNGLLGGVMTLLVGLGLMKRKKKKDENDQDDSQA

SEQ ID NO: 33562 - protein, 681 aa, Staphylococcus aureus
  subsp. aureus
  strain ED133
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNSNANPSDVNQGLEQAINDGKQSKVASQQQSKEADNSQDSNANNNLPSQSRTKEALPLNKSNQTSQPEIVNKTEIEKVQPQQNNQANDKITNYNFNNEKEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVKQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVHTREELQDFWHHLADDLVKTEKVTDTKQA

SEQ ID NO: 33563 - protein, 958 aa, Staphylococcus aureus
  subsp. aureus
  strain ED133
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTAYVNQPKNTYTKQTFVTNLTGYKFNPNAKNFKIYEVTDQNQFVDSFTPDTSKLKDVTGQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTKDDKDADGGEVDVTITDHDDFTLDNGYFEEETSDSDSDSDSDSDSDSDSDSDSDSDSDSDSDSDSDSDSDSDSDSDSDSDSDSDSELDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDAGKHTPAKPMSAVKDHHNKAKALPETGSENNGSNNATLFGGLFAALGSLLLFGRRKKQNK

SEQ ID NO: 33564 - protein, 1347 aa, Staphylococcus aureus
  subsp. aureus
  strain ED133
MLNRENKTAMTRKGMVSNRLNKFSIRKYTVGTASILVGTTLIFGLGSQEAKAAEVTNKEMKEDATSVNNDQVSKKVDTEQLNNDGNTSKVDTEQLKDENINKVANQKEVTRVENSVASEKNNNSKPSENGKLQTSDVKKTEDNNATSDDQVTTTVNSQQLNTDNTTSMSSAPINVRKDDLKFNNEEVRNVGEKSDNTDNANSSELIKPKTTEPKRLNTRMRIAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVDKKDVPFSVTIGNQTTTTTADITYPAYKEADNNSIGSAFTETVSHVGNAEDPGYYNQVVYVNPMDKDLKGANLKVEAYHPKYPANIGQINQNVTNIKIYRVPEGYTLNKGYDVNANDLVDVTDEFKNKMAYGTNQSVNIDFGDITSAYVVMVNTKFQYTNSESPTLVQMATLSSTGNKTVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDINKNGIQDQDEKGISGVTVTLKDENGNVLKTVTTDADGKYKFTDLDNGNYKVEFTTPEGYTPTSTNTGGNDTVDSNGLTTTGVINGADNMTLDSGFYKTPKYNLGNYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFENPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGTHTPVKPMSTTKDHHNKAKALPETGSENNGSNNATLFGGLFAALGSLLLFGRRKKQNK

SEQ ID NO: 33565 - protein, 1099 aa, Staphylococcus aureus
  subsp. aureus
  strain ED133
MINRDNKKAITKKGMISNRLNKFSIRKYTVGTASILVGTTLIFGLGNQEAKAAENTSTENAKQDDATTSDNKEVVSETENNSTTENNSTNPIKKERNTDSQPEAKEESTTSSTQQQQNNVTATTETKPQNIEKENVKPSTDKTATEDTSVILEEKKAPNNTNNDVTTKSSTSEIQTKPTTPQESTNIENSQPQPTPSKVDNQVTDATNPKEPVNVSKEELKNNPEKLKELVRNDSNTDRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDGELDIAQGTSMRTTDNYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDTDNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 33566 - protein, 434 aa, Staphylococcus aureus [sequence omitted]

SEQ ID NO: 33567 - protein, 931 aa, Staphylococcus aureus
  subsp. aureus
  strain ED133
MNMKKKEKHAIRKKSIGVASVLVGTLIGFGLLSSKEADASENSVTQSDSASNESKSSDSSSVNAAPKTDNTNVSDTKTTSNTNNGETSVAQNPAQQETTQSASTNATTEETPVTGEATTTATKQANTPATTQSSNTNAEELVNQTSNERASNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDEDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSDSDSASDSDSASDSDSASDSDSASDSDSASDSDSDSDSDSDSDSDSDSDSDSDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSASDSDSGSDSDSASDSDSGSDSDSASDSDSGSDSDSSSDSDSDSASDSTSDTESDNDSDSESDSNSDSDSGSNNNVVPPNSPKNGTNAFNKNEAKDSKEPLPDTGSEGEANSSLIWGLLASLGSLLLFRRKKENKDKK

SEQ ID NO: 33568 - protein, 259 aa, Staphylococcus aureus
  subsp. aureus
  strain ED133
MKKRKTAFILTLCIVIMLVTSPLVNGSEKSEEIKEKDLHKKSELQGVALDNLRQIYYHNGKAITENKESDNQFLQHTILFNGFFTDHPWYNDLLVDFDSKVLADKYKGKKVDLYGAYYGYQCAGGTPNKTACMYGGVTLHDNNRLTEEKKVPINLWLDGKQNTVPLETVKTNKKEVTVQELDLQARHYLHGKYNLYNSDTFDGKVQRGLIVFHTSTEPSVNYDLFGAQGQYSNTLLRIYRDNKTINSENMHIDIYLYTT

SEQ ID NO: 33569 - protein, 641 aa, Staphylococcus aureus
  subsp. aureus
  strain ED133
MNKQQKEFKSFYSIRKSSLGVASVAISTLLLLMSNSEAQAAEETGGTNTEAQPKTEAVASPSTTTEKAPEAKPVANAVSVSNKEVEAPTSETKEAKEVKAPKETKEVKPGAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSAEKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYIEGKTLYDAIVKVHVKTIDYDGQYHVRIVDKEAFTKANADKSNKKEQQDNSAKKETTPAKPSKPTPSPVEKESQKQDSQKDDNKQSPSVEKENDASSESGKDKTPSTKPAKAEVESSSTTPTKVVSTTQNVAKPTTASSETTIDVVQTSAGSSEAKDSAPLQKANIKNTNDGHTQSQNNKNTQENKAKSLPQTGEESNKDMTLPLMAFLALSSIVAFVLPRKRKN

SEQ ID NO: 33570 - protein, 354 aa, Staphylococcus aureus
  subsp. aureus
  strain ED133
MTKHYLNSKYQSEQRSSAMKKITMGTASIILGSLVYIGADSQQVNAATEATNATNNQSAQVSQATSQPINFQVQKDGSSEKSHMDDYMQHPGKVIKQNNKYYFQAVLNSASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKIEKVKPTVTTTSKVEDNHSTKVVSTDTTKDQTKTQSAHTVKTTQTAQEQNKVQTPVKDVATAKSESNNQAVSDNKSQQTNKVTKQNEVHKQETSKDSKAKELPKTGLTSVDNFISTVAFATLALLGSLSLLLFKRKESK

SEQ ID NO: 33571 - protein, 109 aa, Staphylococcus aureus
  subsp. aureus
  strain ED133
MKKNFIGKSILSIAAISLTVSTFASESHAQTKNAETVKKYNEYQTNFKKQVNKKVVDAQKAVNLFKRTRTVATHRKAQRAVNLIHFQHSYEKKKLQRQIDLVLKYNTLK

SEQ ID NO: 33572 - protein, 165 aa, Staphylococcus aureus; identical to SEQ ID NO: 31315
  subsp. aureus
  strain ED133

SEQ ID NO: 33573 - protein, 319 aa, Staphylococcus aureus; identical to SEQ ID NO: 30495
  subsp. aureus
  strain ED133

SEQ ID NO: 33574 - protein, 238 aa, Staphylococcus aureus
  subsp. aureus
  strain ED133
MNKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNFTIDLSKRLHSDLANVYVKNPNKITVDVLFD

SEQ ID NO: 33575 - protein, 241 aa, Staphylococcus aureus
  subsp. aureus
  strain ED133
MNNNITKKIILSTTLLLLGTASTQFPNTPISSSTEAKAYYINQNETNVNELTKYYSQKHLTFSNKTLWQKDNGTIHATLLQFSWYSHIQVYGPESWGNINQLRNKSVDIFGIKDQETIDSFALSQETFTGGVTPAATPNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 33576 - protein, 241 aa, Staphylococcus aureus
  subsp. aureus
  strain ED133
MKKNIMNKLVLSTALLLLGTTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNEEFNKGQIKITADGNNYTIDLSKKLKLTDTNRYVKNPKNAQIEVILEKSN

SEQ ID NO: 33577 - protein, 691 aa, Staphylococcus aureus
  subsp. aureus 11819-97
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKHSHQNNATNNTERQNDQVQNTHHAERNGSQSTTSQSNDVDKSQPSIPAQKVLPNHDKAAPTSTTPPSNDKTAPKSTKAQDATTEKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 33578 - protein, 896 aa, Staphylococcus aureus
  subsp. aureus 11819-97
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDMVKDTDSSVDKDAHLNIDHSSTNMMNNNHFDKYDLKEMDTQIAKDTDRNVDKDADNSVGMSSNVDTDKDSNKNKDKVIQLNHIADKNNHTGKAAKLDVVKQNYNNTDKVTDKKITEHLPSDIHKTVDKTVKTKEKAGTPSKENKLSQSKMLPKTGETTSSQSWWGLYALLGMLALFIPKFRKESK

SEQ ID NO: 33579 - protein, 309 aa, Staphylococcus aureus
  subsp. aureus 11819-97
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGENFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 33580 - protein, 315 aa, Staphylococcus aureus; identical to SEQ ID NO: 30573
  subsp. aureus 11819-97

SEQ ID NO: 33581 - protein, 325 aa, Staphylococcus aureus; identical to SEQ ID NO: 30407
  subsp. aureus 11819-97

SEQ ID NO: 33582 - protein, 203 aa, Staphylococcus aureus
  subsp. aureus 11819-97
MFKKNDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYRVADRVYTPKRNITLNKEVVTLKELDHIIRFAHISYGLYMGEHLPKGNIVINTKNGGKYTLESHKELQKDRENVKINTDDIKNVTFELVKSVNDIEQV

SEQ ID NO: 33583 - protein, 2186 aa, Staphylococcus aureus
  subsp. aureus 11819-97
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSADAKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTINTNPYTIDIIMNKDALQAEVDRRIQQADYTFASLDIFNGLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVGVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYETKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKTTALQQIQNIATNKINLIKANNEATDEEQNIAIAQVEKELIKAKQQIASAVTNADVAYLLHNEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 33584 - protein, 331 aa, Staphylococcus aureus; identical to SEQ ID NO: 31305
  subsp. aureus 11819-97

SEQ ID NO: 33585 - protein, 987 aa, Staphylococcus aureus
  subsp. aureus 11819-97
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKVWEANISDLGLDKSEAYNFLITSSQRQGTSQGVYANGWMRTDLNNSTFKLTPNLVKKTEIKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 33586 - protein, 931 aa, Staphylococcus aureus
  subsp. aureus 11819-97
MIVVGMGQEKEAAASEQNNTTVEESGSSATESKASETQTTTNNVNTIDETQSYSVTSTEQLSQSTQVTTEEAPTTVQAPKVETSRVDLPSEKVADKETTGTQVDIAQPSNVSEIKPRMKRSTDVAVVAGEAKATGTDVTGKVKVTESSLEGHKQGTNVVNPHNAERVTLKYKWNFDEGIKAGDYFDFTLSNNVETHGISPLRKVPDIKSKDDNIVAVGHVLDERKIRYIFKEYVKDKKDLTAELSLNLFIDPTTVTKQGKQTIEVKLGENKISKEFDIKYLDGVKDKWGVTVNGRITLLDKQNNKIHHLAYINPKKSEMTSITINGFFAKGGLSTESTPTVKVYEYLGSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNDPIIEKSEPIELDIKSEPPVEKHELTGTIEESNDSKSIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYDVIEEIEENSHVDIKSELGYEGGQNSGNQSFEEDTEEDKPKYEQGGNIVDIDFDSVPQIHGQNNGNQSFEEDTEKDKPKYEHGGNIIDIDFDSVPHIHGFNKYTEIIEEDTNKDKPNYQFGGHNSVDFEEDTLPQVSGQNEGQQTIEEDTTPPIVPPTPPTPEVPSEPETPTPPTPEVPSEPETPTPSTPEVPSEPEVPTPPTPEVPTEPGKPVPPAKEEPKKPSKPVEQGKVVTPVIEINEKVKAVAPTKQKQPKKTELPETGGEESTNKGMLFGGLFSILGLALLRRNKKNHKA

SEQ ID NO: 33587 - protein, 1019 aa, Staphylococcus aureus
  subsp. aureus 11819-97
MIVVGMGQDKEAAASEQKTTTVEENGNSATDNKTSETQTTATNVNHIEETQSYNATVTEQPSNATQVTTEEAPKAVQAPQTAQPANLETVKEEVVKEEAKPQVKETTQSQDNSGDQRQVDLTPKKATQNQVAEIQVEVAQPRTVSESKPRVTRSADVVDAKEAKVETGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVTANLNLNLFIDPRIVKNNGEETLTSKLNGKNTEKKIEVEYKDGIGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEEFTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNNGNQSFEEDTEKDKPKYEHGGNIIDIDFDSVPHIHGFNKHTEIIEEDTNKDKPSYQFGGHNSVDFEEDTLPKVSGQNEGQQTIEEDTTPPTPPTPEVPSEPETPTPPTPEVPSEPETPTPPTPEVPSEPEIPTPPTPEVPSEPETPTPPTPEVPAEPETPTPPTPEVPAEPGKPVPPAKEEPKKPSKPVEQGKVVTPVIEINEKVKAVAPTKKAQSKKSELPETGGEEPTNKGMLFGGLFSILGLALLRRNKKNHKA

SEQ ID NO: 33588 - protein, 226 aa, Staphylococcus aureus
  subsp. aureus 11819-97
MKFKAIAKASLALGMLATGVITSNIQSVQAKTEVKQQSESELKHYYNKPFFERKNVTGYKYTENGKDYMEVATDHQYYQISLLGPDKDKFKEGNNPGLDIFVVREGDSRQAANYSIGGVTKTNSQPFIDYIHTPILEIKKGKEEPQSSLYQIYKEDISLKELDYRLRERAIKQHGLYSNGLKQGQITITMNDGTTHTIDLSQKLEKERMGESIDGTKINKILVEMK

SEQ ID NO: 33589 - protein, 231 aa, Staphylococcus aureus
  subsp. aureus 11819-97
MKMKNIAKISLLLGILATGVNTTTEKPVYAEKKPIVISENSKKLKAYYNQPSIEYKNVTGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 33590 - protein, 356 aa, Staphylococcus aureus
  subsp. aureus 11819-97
MKMRTIAKTSLALGLLTTGAITVTTQSVKAEKVQSTIVDKVPTLKAERSAMINITTGANTVTTQAANTGQERTPKLEKAPNTNEEKTSTSKIEKVSQPKQEAQKLLNISATPAPKQEQSQTTTESTTPKTKVTTPPSTNTPQPMQSTKSDTPQSPTIKQAQTDITPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKAELSITKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 33591 - protein, 279 aa, Staphylococcus aureus
  subsp. aureus 11819-97
MKITTIAKTSLALGLLTTGVITTTTQAANATTPPSTKVEAPQQTPNATTPSSTKVEAPQSKPNATTPSSTKVETPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKDGGKYTFELHKKLQENRMADVIDGTNIDNIEVNIK

SEQ ID NO: 33592 - protein, 234 aa, Staphylococcus aureus; identical to SEQ ID NO: 33390
  subsp. aureus 11819-97

SEQ ID NO: 33593 - protein, 231 aa, Staphylococcus aureus
  subsp. aureus 11819-97
MKLKTLAKATLALGLLTTGVITSEGQAVHAKEKQERVQHLYDIKDLHRYYSSESFEFSNISGKVENYNGSNVVRFNQEKQNHQLFLLGEDKAKYKQGLQGQDVFVVKELIDPNGRLSTVGGVTKKNNQSSETNIHLLVNKLDGGNLDATNDSFLINKEEVSLKELDFKIRKQLVEKYGLYQGTSKYGKITIILNGGKKQEIDLGDKLQFERMGDVLNSKDINKIEVTLKQI

SEQ ID NO: 33594 - protein, 232 aa, Staphylococcus aureus
  subsp. aureus 11819-97
MKFTAIAKAIFVLGILTTSAMITENQSVNAKGKYEKMNRLYDTNKLHQYYSGPSYELTNVSGQSQGYYDSNVLLFNQQNQKFQVFLLRKDENKYKEKTHGLDVFAVPELVDLDGRIFSVSGVTKKNVKSIFESLRTPNLLVKKIDDKDGFSYDEFFFIQKEEVSLKELDFKIRKLLIKKYKLYEGAADKGRIVINMKDENKYEIDLSDKLGFERMADVINSEQIKNIEVNLK

SEQ ID NO: 33595 - protein, 232 aa, Staphylococcus aureus; identical to SEQ ID NO: 31335
  subsp. aureus 11819-97

SEQ ID NO: 33596 - protein, 227 aa, Staphylococcus aureus; identical to SEQ ID NO: 30585
  subsp. aureus 11819-97

SEQ ID NO: 33597 - protein, 232 aa, Staphylococcus aureus
  subsp. aureus 11819-97
MKLKNIAKASLALGILTTGMITTTAQPVKADEASSRLSVTSKDTQNLKTYYTGASFDLRGLSGYKEGDKVIFPQNGQQIDVTLTGKEGDVVQSNDDVTNVDVFAVPEGTGRSAIMTTIGGITTPNTQSYKDTTNNVNLRVSKSTSPNTISVSVKNYDIFKEKISLKELDFKLRKHLIDNHDLYKTEPKDSKIRINMKDGGYYTFELNKKLQTHRMGDVIDGTKIKEINVELN

SEQ ID NO: 33598 - protein, 647 aa, Staphylococcus aureus
  subsp. aureus 11819-97
MNKQQKEFKSFYSIRKSSLGVASVAISTLLLLMSNGEAQAAEETGGTNTEAQPKTEAVASPTTTSEKAPETKPVANAVSVSNKEVEAPTSETKEAKEVKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVVKPTTASSKTTKDVVQTSAGSREAKDSAPLQKANIKNTNDGHTQSQNNKNTQENKAKSLPQTGEESNKDMTLPLMALLALSSIVAFVLPRKRKN

SEQ ID NO: 33599 - protein, 350 aa, Staphylococcus aureus; identical to SEQ ID NO: 30602
  subsp. aureus 11819-97

SEQ ID NO: 33600 - protein, 105 aa, Staphylococcus aureus
  subsp. aureus 11819-97
MKKNFIGKSILSIAAISLTVSTFAGESHAQTKVEKYNEYQTNFKKQVNKKVMDAQKAVNLFKRTRTVATHRKAQRAVNLIHFQHSYEKKKLQRQIDLVLKYNTLK

SEQ ID NO: 33601 - protein, 327 aa, Staphylococcus aureus; identical to SEQ ID NO: 30538
  subsp. aureus 11819-97

SEQ ID NO: 33602 - protein, 311 aa, Staphylococcus aureus; identical to SEQ ID NO: 30617
  subsp. aureus 11819-97

SEQ ID NO: 33603 - protein, 165 aa, Staphylococcus aureus
  subsp. aureus 11819-97
MKNKLIAKPLLTLAAIGITTTTIASTADASEGYGPREKKPVSINHNIVEYNDGTFKYQSRPKFNSTPKYIKFKHDYNILEFNDGTFEYGARPQFNKPAAKTDANIKKEQKLIQAQNLVREFEKTHTVSAHRKAQKAVNLVSFEYKVKKMVLQERIDNVLKQGLVK

SEQ ID NO: 33604 - protein, 319 aa, Staphylococcus aureus; identical to SEQ ID NO: 30605
  subsp. aureus 11819-97

SEQ ID NO: 33605 - protein, 238 aa, Staphylococcus aureus; identical to SEQ ID NO: 30740
  subsp. aureus 11819-97

SEQ ID NO: 33606 - protein, 241 aa, Staphylococcus aureus; identical to SEQ ID NO: 30739
  subsp. aureus 11819-97

SEQ ID NO: 33607 - protein, 241 aa, Staphylococcus aureus
  subsp. aureus 11819-97
MKKNIMNKLVLSTALLLLGTTSTQLPKTPISFSSEAKAYNISEKETNINELIKYYTQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 33608 - protein, 221 aa, Staphylococcus aureus
  subsp. aureus 11819-97
MKAKLWFLLTTLAFLIAVTGSIGIAEVKAKTTGLITENSNDSLKEHYAQKFEVYTNKEVTGVGENYIDAKVDTYNVRTVLYNTDYLKQFKNQDKVNIWGTLYENQQSKVYRGTVVKYDPISKVTNLSYRMNLFVNGHQTKVNPDSLLEVKNKQISLKETDFRIRKYLLEKEHLYSNYNSGELIIEMKNGARHKIDLGDILSDSQEKTFDFDNISHIDIYMK

SEQ ID NO: 33609 - protein, 233 aa, Staphylococcus aureus; identical to SEQ ID NO: 33414
  subsp. aureus 11819-97

SEQ ID NO: 33610 - protein, 198 aa, Staphylococcus aureus; identical to SEQ ID NO: 31544
  subsp. aureus 11819-97

SEQ ID NO: 33611 - protein, 865 aa, Staphylococcus aureus
  subsp. aureus 11819-97
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNEKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSDSDSDSDSDSDSESDSDSDSDSESDSDSDSDSDSDSDSDNDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSESDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33612 - protein, 945 aa, Staphylococcus aureus
  subsp. aureus 11819-97
MNNKKTATNRKGMIPNRLNKFSIRKYSVGTASILVGTTLIFGLSGHEAKAAEHTNGELNQSKNETTGTSENKTTEKVDSRQLKDNTQTATADQPKVTMSDSATVKETSSNMQSPQNATANQSTTQTSNVTTNDKSATTYSNDTSKSNLTQAKDVSTKPKTTTIKPRTLNRMAVNTVAAPQQGTNVNDKVHFKNIDIAIDKGHVNKDTGKTEFWATSSDVLKLKANYTIDDSVKEGDTFTFKYGQYFRPGSVRLPSKTQNLYNAQGNIIAKGIYDSATNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTNQNQFVDSFTPDTSKLTDVTDQFDINYSNDNKTATVDLMKGQKSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAIDSDGLTTTGVIKDADNMTLDSGFYKTPKYSLGDYVWYDSNKDGKQDSTEKGIKGVKVTLQNEKGEVIGTTETDSNGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDNDSDSDSDSDSDSDSDSDSDSDAGKHTPTKPMSTVKDQHKTAKALPETGSENNNSNNGTLFGGLFAALGSLLLFGRRKKQNK

SEQ ID NO: 33613 - protein, 1405 aa, Staphylococcus aureus
  subsp. aureus 11819-97
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGNDTEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33614 - protein, 1151 aa, Staphylococcus aureus
  subsp. aureus 11819-97
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33615 - protein, 372 aa, Staphylococcus aureus
  subsp. aureus 11819-97
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVVNNNEPTKEIKIANLEAQNSNQEKMNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 33616 - protein, 96 aa, Staphylococcus aureus; identical to SEQ ID NO: 30813
  subsp. aureus 11819-97

SEQ ID NO: 33617 - protein, 2189 aa, Staphylococcus aureus
  subsp. aureus 11819-97
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 33618 - protein, 681 aa, Staphylococcus aureus
  subsp. aureus 11819-97
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVTSQQQSKEADNSQDSNANNNLPSQSLTKEAPSLNKLDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 33619 - protein, 274 aa, Staphylococcus aureus
  subsp. aureus 11819-97
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCSAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33620 - protein, 338 aa, Staphylococcus aureus; identical to SEQ ID NO: 31292
  subsp. aureus 11819-97

SEQ ID NO: 33621 - protein, 350 aa, Staphylococcus aureus
  subsp. aureus 11819-97
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYASPILEKNKEGQRLIVTYEVDWKNKTVKVVDKYSDNKSFREG

SEQ ID NO: 33622 - protein, 44 aa, Staphylococcus aureus; identical to SEQ ID NO: 30513
  subsp. aureus 11819-97

SEQ ID NO: 33623 - protein, 231 aa, Staphylococcus aureus
  subsp. aureus 11819-97
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 33624 - protein, 325 aa, Staphylococcus aureus; identical to SEQ ID NO: 30484
  subsp. aureus 11819-97

SEQ ID NO: 33625 - protein, 312 aa, Staphylococcus aureus; identical to SEQ ID NO: 30391
  subsp. aureus 11819-97

SEQ ID NO: 33626 - protein, 2502 aa, Staphylococcus aureus
  subsp. aureus 11819-97
MNLFRQQKFSIRKFNVGIFSALIATVTFISTNPTTASAAEQNQPAQNQPAQPADANAQPNANAGAQANPAAQPAAPANQGQPAAQPANQGGQANPAGGAAQPAGGAAQPAAGTAQPAGQGNQADPNNAAQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKQAAYTELDTKKQEARTNLDAANTNSAVTTAKDNGIAAINQVQAATTKKSDAKAEIAQKASERKTAIEAMNDSTTEEQQAAKEKVDQAVLSANADIDNAAANTDVDNAKTTNEATIAAITPDANVKPQAKQAIADKVQAQEKAIDANNGSTTEEKAAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKAIQAIAAATTNAQVDEAKTNAEAAINAVTPKVVKKQTAKDEIDQLQATQTNVINNDQNATTEEKEAAIQQLATAVTDAKNNITAATDDNGVDQAKDAGKNSIQSTQPATSVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQLKSETNVASNEADKSPSKADTEVSNKPSTSASSEAKEKMTSTNVSQKDDTATADTNDMQTSVGSVANNKAKDMQTNDTQTSVGPVANNKATQNDGANASPATVSNGSHSMHQDMLNVTKTEENKANAKSDQQGKVNKPKQQAKTLPDTGMSHNDDLPYAELALGAGMAFLIRRFTKKDQQTEE

SEQ ID NO: 33627 - protein, 484 aa, Staphylococcus aureus
  subsp. aureus 11819-97
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33628 - protein, 240 aa, Staphylococcus aureus
  subsp. aureus 11819-97
MKKLATVGSLIVTSTLVFSSMPFQNAHADTTSMNVSNKQSQNVQNHRPYGGVVPQGMTQAQYTELEKALPQLSAGSNMKDYNMKLYDATQNIADKYNVIITTNVGVFKPHAVRDMNGHALPLTKDGNFYQTNVDANGINHGGSEMVQNKTGHMSQQGHMNQNTHMNQQPHMQQGHMQSSNHQMMSPKANMQSSNHQMNQSNKKVLPAAGESMTSSILTASIAALLLVSGLFLAFRRRSTN

SEQ ID NO: 33629 - protein, 434 aa, Staphylococcus aureus [sequence omitted]

SEQ ID NO: 33630 - protein, 809 aa, Staphylococcus aureus
  subsp. aureus 11819-97
MTYRIKKWQNLSTITLLMAGVITLNGGEFRSIDKYQIAVADTNVQTPNYEKLRNTWLDVNYGYDKYDEKNDAMKKKFEATENEAKKLLSEMKTESDRKYLWENSKDLDTKSADMTRTYRNIEKIAEAMRHKDTKLKTDENKKKVKDALEWLHKNAYGKEPDKKVADLKTNFSKSAPQKNTNLNWWDYEIGTPKSLTNTLILLNDQFSNEEKKKFTAPIKTFAPDSDKILSSVGKAEPAKGGNLVDISKVKLLESIIEEDKDMTKNSIDSFNKVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSASATVMKSLLRLSDAMDESTKAKYKKIVKSSVESDSSYKQNDYLNSYSDIDKMKSLMDDSTISTNGLTQQLKIYNDMDRVTYHNKDLDFAFGLSMTSKNVARYESINNENLKGWHTGAGMSYLYNSDVKHYRDNFWTTADMKRLAGTTTLENEVLKDTDDKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNKSKISIKKETHTGNWKEINKSQKDTRKTDEYYEVTQKHSNSDNKYGYVLYPGLSKDDFKTKKDEVTVVKQEDDFHVVKDNESVWAGVNYSDSTQTFIINNTKVEVKAKGMFILKKKDDKTYECSFYNPESTNSASDIESKISMTGYSITNKNTSTYNESGVHFELTK

SEQ ID NO: 33631 - protein, 247 aa, Staphylococcus aureus
  subsp. aureus 11819-97
MKDTIVKFLSAFLVISSISLIDTSFSSKYNKISIAAETKNFTDLVEATKWGNSLIKSAKYSSKDKMAIYNYTKNSSPINTPLRSANGDVNKLSENIQEQVRQLDSTISKSVTPDSVYVYRLLNLDYLSSITGFTREDLHMLQQTNNGQYNEALVSKLNNLMNSRIYRENGYSSTQLVSGAALAGRPIELKLELPKGTKAAYIDSKELTAYPGQQEVLLPRGTEYAVGSVKLSDNKRKIIITAVVFKK

SEQ ID NO: 33632 - protein, 141 aa, Staphylococcus aureus; identical to SEQ ID NO: 30524
  subsp. aureus 11819-97

SEQ ID NO: 33633 - protein, 970 aa, Staphylococcus aureus
  subsp. aureus 11819-97
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTVPAYIDPENVTKTGNVTLTTGIGTNTASKTVLIDYEKYGQFHNLSIKGTIDQIDKTNNTYRQTIYVNPSGDNVVLPVLTGNLIPKSNSNALIDANNTNIKVYKVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDLDSDSDSDSDSDSDSDSDSDSDSESDSDSDSGSNNNVVPPNSPKNGTNASNKNEAKDSKEPLPDTGSEDEANTSLIWGLLASLGSLLLFRRKKENKDKK

SEQ ID NO: 33634 - protein, 250 aa, Staphylococcus aureus
  subsp. aureus 11819-97
MGEFEVKYLTGFILILLLEGIFTNSASAIEYSDLHHKSKFDSKRLSNAKMSFINPNQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKYHYDDEQNVEYDFYNLNGEYGREVLKMYADNKTINSDKLHLDIYLFKS

SEQ ID NO: 33635 - protein, 291 aa, Staphylococcus aureus; identical to SEQ ID NO: 30390
  subsp. aureus 11819-97

SEQ ID NO: 33636 - protein, 825 aa, Staphylococcus aureus
  subsp. aureus 21172
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSD

SEQ ID NO: 33637 - protein, 891 aa, Staphylococcus aureus; identical to SEQ ID NO: 30788
  subsp. aureus 21172

SEQ ID NO: 33638 - protein, 2186 aa, Staphylococcus aureus; identical to SEQ ID NO: 30789
  subsp. aureus 21172

SEQ ID NO: 33639 - protein, 331 aa, Staphylococcus aureus; identical to SEQ ID NO: 30615
  subsp. aureus 21172

SEQ ID NO: 33640 - protein, 327 aa, Staphylococcus aureus; identical to SEQ ID NO: 30616
  subsp. aureus 21172

SEQ ID NO: 33641 - protein, 311 aa, Staphylococcus aureus; identical to SEQ ID NO: 30617
  subsp. aureus 21172

SEQ ID NO: 33642 - protein, 258 aa, Staphylococcus aureus; identical to SEQ ID NO: 30410
  subsp. aureus 21172

SEQ ID NO: 33643 - protein, 165 aa, Staphylococcus aureus; identical to SEQ ID NO: 30805
  subsp. aureus 21172

SEQ ID NO: 33644 - protein, 131 aa, Staphylococcus aureus; identical to SEQ ID NO: 30867
  subsp. aureus 21172

SEQ ID NO: 33645 - protein, 242 aa, Staphylococcus aureus; identical to SEQ ID NO: 30399
  subsp. aureus 21172

SEQ ID NO: 33646 - protein, 239 aa, Staphylococcus aureus; identical to SEQ ID NO: 30622
  subsp. aureus 21172

SEQ ID NO: 33647 - protein, 254 aa, Staphylococcus aureus; identical to SEQ ID NO: 30809
  subsp. aureus 21172

SEQ ID NO: 33648 - protein, 319 aa, Staphylococcus aureus; identical to SEQ ID NO: 30605
  subsp. aureus 21172

SEQ ID NO: 33649 - protein, 238 aa, Staphylococcus aureus; identical to SEQ ID NO: 30606
  subsp. aureus 21172

SEQ ID NO: 33650 - protein, 241 aa, Staphylococcus aureus; identical to SEQ ID NO: 30607
  subsp. aureus 21172

SEQ ID NO: 33651 - protein, 241 aa, Staphylococcus aureus; identical to SEQ ID NO: 30608
  subsp. aureus 21172

SEQ ID NO: 33652 - protein, 372 aa, Staphylococcus aureus; identical to SEQ ID NO: 30609
  subsp. aureus 21172

SEQ ID NO: 33653 - protein, 62 aa, Staphylococcus aureus; identical to SEQ ID NO: 30610
  subsp. aureus 21172

SEQ ID NO: 33654 - protein, 138 aa, Staphylococcus aureus; identical to SEQ ID NO: 30785
  subsp. aureus 21172

SEQ ID NO: 33655 - protein, 291 aa, Staphylococcus aureus; identical to SEQ ID NO: 30390
  subsp. aureus 21172

SEQ ID NO: 33656 - protein, 659 aa, Staphylococcus aureus
  subsp. aureus 21172
MTYRMKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKKVILVSGVI

SEQ ID NO: 33657 - protein, 120 aa, Staphylococcus aureus
  subsp. aureus 21172
MLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 33658 - protein, 141 aa, Staphylococcus aureus; identical to SEQ ID NO: 30633
  subsp. aureus 21172

SEQ ID NO: 33659 - protein, 231 aa, Staphylococcus aureus; identical to SEQ ID NO: 30630
  subsp. aureus 21172

SEQ ID NO: 33660 - protein, 2481 aa, Staphylococcus aureus; identical to SEQ ID NO: 30631
  subsp. aureus 21172

SEQ ID NO: 33661 - protein, 241 aa, Staphylococcus aureus; identical to SEQ ID NO: 30571
  subsp. aureus 21172

SEQ ID NO: 33662 - protein, 508 aa, Staphylococcus aureus
  subsp. aureus 21172
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNNKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33663 - protein, 681 aa, Staphylococcus aureus; identical to SEQ ID NO: 30598
  subsp. aureus 21172

SEQ ID NO: 33664 - protein, 2271 aa, Staphylococcus aureus; identical to SEQ ID NO: 30597
  subsp. aureus 21172

SEQ ID NO: 33665 - protein, 738 aa, Staphylococcus aureus
  subsp. aureus 21172
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDS

SEQ ID NO: 33666 - protein, 227 aa, Staphylococcus aureus; identical to SEQ ID NO: 30586
  subsp. aureus 21172

SEQ ID NO: 33667 - protein, 227 aa, Staphylococcus aureus; identical to SEQ ID NO: 30585
  subsp. aureus 21172

SEQ ID NO: 33668 - protein, 232 aa, Staphylococcus aureus; identical to SEQ ID NO: 30584
  subsp. aureus 21172

SEQ ID NO: 33669 - protein, 232 aa, Staphylococcus aureus; identical to SEQ ID NO: 30583
  subsp. aureus 21172

SEQ ID NO: 33670 - protein, 231 aa, Staphylococcus aureus; identical to SEQ ID NO: 30582
  subsp. aureus 21172

SEQ ID NO: 33671 - protein, 234 aa, Staphylococcus aureus; identical to SEQ ID NO: 30581
  subsp. aureus 21172

SEQ ID NO: 33672 - protein, 292 aa, Staphylococcus aureus; identical to SEQ ID NO: 30580
  subsp. aureus 21172

SEQ ID NO: 33673 - protein, 356 aa, Staphylococcus aureus; identical to SEQ ID NO: 30579
  subsp. aureus 21172

SEQ ID NO: 33674 - protein, 231 aa, Staphylococcus aureus; identical to SEQ ID NO: 30578
  subsp. aureus 21172

SEQ ID NO: 33675 - protein, 226 aa, Staphylococcus aureus; identical to SEQ ID NO: 30577
  subsp. aureus 21172

SEQ ID NO: 33676 - protein, 203 aa, Staphylococcus aureus; identical to SEQ ID NO: 30576
  subsp. aureus 21172

SEQ ID NO: 33677 - protein, 691 aa, Staphylococcus aureus; identical to SEQ ID NO: 30511
  subsp. aureus 21172

SEQ ID NO: 33678 - protein, 645 aa, Staphylococcus aureus; identical to SEQ ID NO: 30601
  subsp. aureus 21172

SEQ ID NO: 33679 - protein, 350 aa, Staphylococcus aureus; identical to SEQ ID NO: 30602
  subsp. aureus 21172

SEQ ID NO: 33680 - protein, 109 aa, Staphylococcus aureus; identical to SEQ ID NO: 30603
  subsp. aureus 21172

SEQ ID NO: 33681 - protein, 149 aa, Staphylococcus aureus
  subsp. aureus 21172
DSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33682 - protein, 96 aa, Staphylococcus aureus; identical to SEQ ID NO: 30813
  subsp. aureus 21172

SEQ ID NO: 33683 - protein, 434 aa, Staphylococcus aureus [sequence omitted]

SEQ ID NO: 33684 - protein, 905 aa, Staphylococcus aureus; identical to SEQ ID NO: 30600
  subsp. aureus 21172

SEQ ID NO: 33685 - protein, 137 aa, Staphylococcus aureus
  subsp. aureus 21172
DSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33686 - protein, 269 aa, Staphylococcus aureus
  subsp. aureus 21172
GQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33687 - protein, 338 aa, Staphylococcus aureus; identical to SEQ ID NO: 30627
  subsp. aureus 21172

SEQ ID NO: 33688 - protein, 351 aa, Staphylococcus aureus; identical to SEQ ID NO: 30628
  subsp. aureus 21172

SEQ ID NO: 33689 - protein, 1012 aa, Staphylococcus aureus; identical to SEQ ID NO: 32617
  subsp. aureus 21172

SEQ ID NO: 33690 - protein, 1337 aa, Staphylococcus aureus; identical to SEQ ID NO: 30811
  subsp. aureus 21172

SEQ ID NO: 33691 - protein, 104 aa, Staphylococcus aureus
  subsp. aureus 21172
SDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 33692 - protein, 165 aa, Staphylococcus aureus; identical to SEQ ID NO: 30418
  subsp. aureus 21172

SEQ ID NO: 33693 - protein, 258 aa, Staphylococcus aureus; identical to SEQ ID NO: 30228
  subsp. aureus 21172

SEQ ID NO: 33694 - protein, 268 aa, Staphylococcus aureus; identical to SEQ ID NO: 30398
  subsp. aureus 21172

SEQ ID NO: 33695 - protein, 259 aa, Staphylococcus aureus; identical to SEQ ID NO: 30226
  subsp. aureus 21172

SEQ ID NO: 33696 - protein, 321 aa, Staphylococcus aureus; identical to SEQ ID NO: 30959
  subsp. aureus 21172

SEQ ID NO: 33697 - protein, 315 aa, Staphylococcus aureus; identical to SEQ ID NO: 30573
  subsp. aureus 21172

SEQ ID NO: 33698 - protein, 325 aa, Staphylococcus aureus; identical to SEQ ID NO: 30407
  subsp. aureus 21172

SEQ ID NO: 33699 - protein, 987 aa, Staphylococcus aureus; identical to SEQ ID NO: 30962
  subsp. aureus 21172

SEQ ID NO: 33700 - protein, 933 aa, Staphylococcus aureus
  subsp. aureus 21172
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 33701 - protein, 1015 aa, Staphylococcus aureus
  subsp. aureus 21172
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTEKGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 33702 - protein, 233 aa, Staphylococcus aureus; identical to SEQ ID NO: 30591
  subsp. aureus 21172

SEQ ID NO: 33703 - protein, 211 aa, Staphylococcus aureus; identical to SEQ ID NO: 30592
  subsp. aureus 21172

SEQ ID NO: 33704 - protein, 227 aa, Staphylococcus aureus; identical to SEQ ID NO: 30585
  subsp. aureus 21178

SEQ ID NO: 33705 - protein, 232 aa, Staphylococcus aureus; identical to SEQ ID NO: 30765
  subsp. aureus 21178

SEQ ID NO: 33706 - protein, 232 aa, Staphylococcus aureus; identical to SEQ ID NO: 31054
  subsp. aureus 21178

SEQ ID NO: 33707 - protein, 231 aa, Staphylococcus aureus; identical to SEQ ID NO: 30560
  subsp. aureus 21178

SEQ ID NO: 33708 - protein, 231 aa, Staphylococcus aureus; identical to SEQ ID NO: 31761
  subsp. aureus 21178

SEQ ID NO: 33709 - protein, 234 aa, Staphylococcus aureus; identical to SEQ ID NO: 31052
  subsp. aureus 21178

SEQ ID NO: 33710 - protein, 250 aa, Staphylococcus aureus; identical to SEQ ID NO: 31910
  subsp. aureus 21178

SEQ ID NO: 33711 - protein, 1174 aa, Staphylococcus aureus
  subsp. aureus 21178
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYKFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDS

SEQ ID NO: 33712 - protein, 108 aa, Staphylococcus aureus
  subsp. aureus 21178
SDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 33713 - protein, 426 aa, Staphylococcus aureus; identical to SEQ ID NO: 31963
  subsp. aureus 21178

SEQ ID NO: 33714 - protein, 231 aa, Staphylococcus aureus; identical to SEQ ID NO: 31073
  subsp. aureus 21178

SEQ ID NO: 33715 - protein, 639 aa, Staphylococcus aureus
  subsp. aureus 21178
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLNGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKP

SEQ ID NO: 33716 - protein, 130 aa, Staphylococcus aureus
  subsp. aureus 21178
EPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 33717 - protein, 291 aa, Staphylococcus aureus; identical to SEQ ID NO: 31911
  subsp. aureus 21178

SEQ ID NO: 33718 - protein, 241 aa, Staphylococcus aureus; identical to SEQ ID NO: 32458
  subsp. aureus 21178

SEQ ID NO: 33719 - protein, 2478 aa, Staphylococcus aureus; identical to SEQ ID NO: 31939
  subsp. aureus 21178

SEQ ID NO: 33720 - protein, 296 aa, Staphylococcus aureus
  subsp. aureus 21178
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVID

SEQ ID NO: 33721 - protein, 331 aa, Staphylococcus aureus; identical to SEQ ID NO: 30732
  subsp. aureus 21178

SEQ ID NO: 33722 - protein, 221 aa, Staphylococcus aureus; identical to SEQ ID NO: 31036
  subsp. aureus 21178

SEQ ID NO: 33723 - protein, 204 aa, Staphylococcus aureus; identical to SEQ ID NO: 31936
  subsp. aureus 21178

SEQ ID NO: 33724 - protein, 807 aa, Staphylococcus aureus
  subsp. aureus 21178
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGN

SEQ ID NO: 33725 - protein, 327 aa, Staphylococcus aureus; identical to SEQ ID NO: 30538
  subsp. aureus 21178

SEQ ID NO: 33726 - protein, 311 aa, Staphylococcus aureus; identical to SEQ ID NO: 31928
  subsp. aureus 21178

SEQ ID NO: 33727 - protein, 946 aa, Staphylococcus aureus
  subsp. aureus 21178
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDS

SEQ ID NO: 33728 - protein, 163 aa, Staphylococcus aureus
  subsp. aureus 21178
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33729 - protein, 802 aa, Staphylococcus aureus
  subsp. aureus 21178
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 33730 - protein, 807 aa, Staphylococcus aureus; identical to SEQ ID NO: 30716
  subsp. aureus 21178

SEQ ID NO: 33731 - protein, 141 aa, Staphylococcus aureus; identical to SEQ ID NO: 30715
  subsp. aureus 21178

SEQ ID NO: 33732 - protein, 340 aa, Staphylococcus aureus
  subsp. aureus 21178
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMA

SEQ ID NO: 33733 - protein, 231 aa, Staphylococcus aureus; identical to SEQ ID NO: 30768
  subsp. aureus 21178

SEQ ID NO: 33734 - protein, 226 aa, Staphylococcus aureus; identical to SEQ ID NO: 30769
  subsp. aureus 21178

SEQ ID NO: 33735 - protein, 203 aa, Staphylococcus aureus; identical to SEQ ID NO: 30770
  subsp. aureus 21178

SEQ ID NO: 33736 - protein, 233 aa, Staphylococcus aureus; identical to SEQ ID NO: 31039
  subsp. aureus 21178

SEQ ID NO: 33737 - protein, 939 aa, Staphylococcus aureus; identical to SEQ ID NO: 31958
  subsp. aureus 21178

SEQ ID NO: 33738 - protein, 1759 aa, Staphylococcus aureus; identical to SEQ ID NO: 31045
  subsp. aureus 21178

SEQ ID NO: 33739 - protein, 681 aa, Staphylococcus aureus; identical to SEQ ID NO: 31046
  subsp. aureus 21178

SEQ ID NO: 33740 - protein, 809 aa, Staphylococcus aureus; identical to SEQ ID NO: 31961
  subsp. aureus 21178

SEQ ID NO: 33741 - protein, 96 aa, Staphylococcus aureus; identical to SEQ ID NO: 30813
  subsp. aureus 21178

SEQ ID NO: 33742 - protein, 330 aa, Staphylococcus aureus; identical to SEQ ID NO: 30381
  subsp. aureus 21178

SEQ ID NO: 33743 - protein, 338 aa, Staphylococcus aureus; identical to SEQ ID NO: 30699
  subsp. aureus 21178

SEQ ID NO: 33744 - protein, 351 aa, Staphylococcus aureus; identical to SEQ ID NO: 30720
  subsp. aureus 21178

SEQ ID NO: 33745 - protein, 116 aa, Staphylococcus aureus
  subsp. aureus 21178
EPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 33746 - protein, 125 aa, Staphylococcus aureus; identical to SEQ ID NO: 33215
  subsp. aureus 21178

SEQ ID NO: 33747 - protein, 203 aa, Staphylococcus aureus
  subsp. aureus 21178
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33748 - protein, 225 aa, Staphylococcus aureus; identical to SEQ ID NO: 30763
  subsp. aureus 21178

SEQ ID NO: 33749 - protein, 434 aa, Staphylococcus aureus [sequence omitted]

SEQ ID NO: 33750 - protein, 927 aa, Staphylococcus aureus; identical to SEQ ID NO: 31940
  subsp. aureus 21178

SEQ ID NO: 33751 - protein, 241 aa, Staphylococcus aureus; identical to SEQ ID NO: 30738
  subsp. aureus 21178

SEQ ID NO: 33752 - protein, 241 aa, Staphylococcus aureus; identical to SEQ ID NO: 31953
  subsp. aureus 21178

SEQ ID NO: 33753 - protein, 238 aa, Staphylococcus aureus; identical to SEQ ID NO: 30740
  subsp. aureus 21178

SEQ ID NO: 33754 - protein, 319 aa, Staphylococcus aureus; identical to SEQ ID NO: 31078
  subsp. aureus 21178

SEQ ID NO: 33755 - protein, 165 aa, Staphylococcus aureus; identical to SEQ ID NO: 30742
  subsp. aureus 21178

SEQ ID NO: 33756 - protein, 109 aa, Staphylococcus aureus; identical to SEQ ID NO: 30744
  subsp. aureus 21178

SEQ ID NO: 33757 - protein, 350 aa, Staphylococcus aureus; identical to SEQ ID NO: 30602
  subsp. aureus 21178

SEQ ID NO: 33758 - protein, 645 aa, Staphylococcus aureus; identical to SEQ ID NO: 30747
  subsp. aureus 21178

SEQ ID NO: 33759 - protein, 895 aa, Staphylococcus aureus
  subsp. aureus 21178
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKNDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 33760 - protein, 2186 aa, Staphylococcus aureus; identical to SEQ ID NO: 31059
  subsp. aureus 21178

SEQ ID NO: 33761 - protein, 370 aa, Staphylococcus aureus
  subsp. aureus 21178
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPVSSNNKSNSNSSTLNYLKTLENRGWDFDGSYGWQCFDLVNVYWNHLYGHGLKGYGAKDIPYANNFNSEAKIYHNTPTFKGEPGDLVVFSGRFGGGYGHTAIVLNGDYDGKLMKFQSLDQNWNNGGWRKAEVAHKVVHNYENDMIFIRPFKKA

SEQ ID NO: 33762 - protein, 325 aa, Staphylococcus aureus; identical to SEQ ID NO: 30407
  subsp. aureus 21178

SEQ ID NO: 33763 - protein, 315 aa, Staphylococcus aureus; identical to SEQ ID NO: 30440
  subsp. aureus 21178

SEQ ID NO: 33764 - protein, 321 aa, Staphylococcus aureus
  subsp. aureus 21178
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANLFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 33765 - protein, 52 aa, Staphylococcus aureus
  subsp. aureus 21189
MHSSNHQMNQSNKKVLPAAGESMTSSILTASIAALLLVSGLFLAFRRRSTNK

SEQ ID NO: 33766 - protein, 458 aa, Staphylococcus aureus
  subsp. aureus 21189
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33767 - protein, 681 aa, Staphylococcus aureus; identical to SEQ ID NO: 32025
  subsp. aureus 21189

SEQ ID NO: 33768 - protein, 2271 aa, Staphylococcus aureus; identical to SEQ ID NO: 31839
  subsp. aureus 21189

SEQ ID NO: 33769 - protein, 632 aa, Staphylococcus aureus
  subsp. aureus 21189
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSDSDSDSDSDS

SEQ ID NO: 33770 - protein, 43 aa, Staphylococcus aureus
  subsp. aureus 21189
SPTITITWKDGSKKEVDLKKDSYTANLFDSNSIKQIDINVKTK

SEQ ID NO: 33771 - protein, 777 aa, Staphylococcus aureus
  subsp. aureus 21189
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSD

SEQ ID NO: 33772 - protein, 109 aa, Staphylococcus aureus; identical to SEQ ID NO: 30744
  subsp. aureus 21189

SEQ ID NO: 33773 - protein, 350 aa, Staphylococcus aureus; identical to SEQ ID NO: 30602
  subsp. aureus 21189

SEQ ID NO: 33774 - protein, 645 aa, Staphylococcus aureus; identical to SEQ ID NO: 30747
  subsp. aureus 21189

SEQ ID NO: 33775 - protein, 225 aa, Staphylococcus aureus; identical to SEQ ID NO: 30763
  subsp. aureus 21189

SEQ ID NO: 33776 - protein, 129 aa, Staphylococcus aureus
  subsp. aureus 21189
DSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33777 - protein, 1159 aa, Staphylococcus aureus
  subsp. aureus 21189
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSD

SEQ ID NO: 33778 - protein, 51 aa, Staphylococcus aureus; identical to SEQ ID NO: 32614
  subsp. aureus 21189

SEQ ID NO: 33779 - protein, 539 aa, Staphylococcus aureus
  subsp. aureus 21189
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRP

SEQ ID NO: 33780 - protein, 917 aa, Staphylococcus aureus; identical to SEQ ID NO: 31037
  subsp. aureus 21189

SEQ ID NO: 33781 - protein, 995 aa, Staphylococcus aureus
  subsp. aureus 21189
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 33782 - protein, 233 aa, Staphylococcus aureus; identical to SEQ ID NO: 30428
  subsp. aureus 21189

SEQ ID NO: 33783 - protein, 241 aa, Staphylococcus aureus; identical to SEQ ID NO: 30738
  subsp. aureus 21189

SEQ ID NO: 33784 - protein, 241 aa, Staphylococcus aureus; identical to SEQ ID NO: 30739
  subsp. aureus 21189

SEQ ID NO: 33785 - protein, 238 aa, Staphylococcus aureus; identical to SEQ ID NO: 30740
  subsp. aureus 21189

SEQ ID NO: 33786 - protein, 319 aa, Staphylococcus aureus; identical to SEQ ID NO: 30741
  subsp. aureus 21189

SEQ ID NO: 33787 - protein, 684 aa, Staphylococcus aureus
  subsp. aureus 21189
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQVEDKKKDKANYQVPYTITVNGTSQNILSNLTFNKNQNISYKDLEDKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSDLKFTGDPRVGYKDISKKVKSVLKHDRGIGERELKYAKKATYTVHFKNGTKKVININSNISQLNLLYVQDIKKIDIDVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 33788 - protein, 250 aa, Staphylococcus aureus; identical to SEQ ID NO: 31910
  subsp. aureus 21189

SEQ ID NO: 33789 - protein, 291 aa, Staphylococcus aureus; identical to SEQ ID NO: 30390
  subsp. aureus 21189

SEQ ID NO: 33790 - protein, 372 aa, Staphylococcus aureus; identical to SEQ ID NO: 31084
  subsp. aureus 21189

SEQ ID NO: 33791 - protein, 895 aa, Staphylococcus aureus; identical to SEQ ID NO: 31734
  subsp. aureus 21189

SEQ ID NO: 33792 - protein, 1329 aa, Staphylococcus aureus
  subsp. aureus 21189
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQQREIKSLLKWRSVLKRLNKHLMQLTKKSRLLLIKSINLKIKQLIKLIKTKQMIR

SEQ ID NO: 33793 - protein, 321 aa, Staphylococcus aureus; identical to SEQ ID NO: 30959
  subsp. aureus 21189

SEQ ID NO: 33794 - protein, 315 aa, Staphylococcus aureus; identical to SEQ ID NO: 30440
  subsp. aureus 21189

SEQ ID NO: 33795 - protein, 325 aa, Staphylococcus aureus; identical to SEQ ID NO: 30407
  subsp. aureus 21189

SEQ ID NO: 33796 - protein, 241 aa, Staphylococcus aureus; identical to SEQ ID NO: 32458
  subsp. aureus 21189

SEQ ID NO: 33797 - protein, 263 aa, Staphylococcus aureus
  subsp. aureus 21189
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKKIKIRNK

SEQ ID NO: 33798 - protein, 327 aa, Staphylococcus aureus; identical to SEQ ID NO: 30538
  subsp. aureus 21189

SEQ ID NO: 33799 - protein, 306 aa, Staphylococcus aureus; identical to SEQ ID NO: 30803
  subsp. aureus 21189

SEQ ID NO: 33800 - protein, 165 aa, Staphylococcus aureus; identical to SEQ ID NO: 30742
  subsp. aureus 21189

SEQ ID NO: 33801 - protein, 151 aa, Staphylococcus aureus
  subsp. aureus 21189
DSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33802 - protein, 274 aa, Staphylococcus aureus; identical to SEQ ID NO: 30872
  subsp. aureus 21189

SEQ ID NO: 33803 - protein, 338 aa, Staphylococcus aureus; identical to SEQ ID NO: 30699
  subsp. aureus 21189

SEQ ID NO: 33804 - protein, 351 aa, Staphylococcus aureus; identical to SEQ ID NO: 30720
  subsp. aureus 21189

SEQ ID NO: 33805 - protein, 331 aa, Staphylococcus aureus; identical to SEQ ID NO: 30732
  subsp. aureus 21189

SEQ ID NO: 33806 - protein, 227 aa, Staphylococcus aureus; identical to SEQ ID NO: 30585
  subsp. aureus 21189

SEQ ID NO: 33807 - protein, 232 aa, Staphylococcus aureus; identical to SEQ ID NO: 30765
  subsp. aureus 21189

SEQ ID NO: 33808 - protein, 232 aa, Staphylococcus aureus; identical to SEQ ID NO: 31054
  subsp. aureus 21189

SEQ ID NO: 33809 - protein, 231 aa, Staphylococcus aureus; identical to SEQ ID NO: 30560
  subsp. aureus 21189

SEQ ID NO: 33810 - protein, 231 aa, Staphylococcus aureus; identical to SEQ ID NO: 31761
  subsp. aureus 21189

SEQ ID NO: 33811 - protein, 234 aa, Staphylococcus aureus; identical to SEQ ID NO: 31052
  subsp. aureus 21189

SEQ ID NO: 33812 - protein, 308 aa, Staphylococcus aureus; identical to SEQ ID NO: 31763
  subsp. aureus 21189

SEQ ID NO: 33813 - protein, 356 aa, Staphylococcus aureus; identical to SEQ ID NO: 31755
  subsp. aureus 21189

SEQ ID NO: 33814 - protein, 231 aa, Staphylococcus aureus; identical to SEQ ID NO: 30768
  subsp. aureus 21189

SEQ ID NO: 33815 - protein, 226 aa, Staphylococcus aureus; identical to SEQ ID NO: 30769
  subsp. aureus 21189

SEQ ID NO: 33816 - protein, 203 aa, Staphylococcus aureus; identical to SEQ ID NO: 30770
  subsp. aureus 21189

SEQ ID NO: 33817 - protein, 690 aa, Staphylococcus aureus; identical to SEQ ID NO: 30419
  subsp. aureus 21189

SEQ ID NO: 33818 - protein, 807 aa, Staphylococcus aureus; identical to SEQ ID NO: 30716
  subsp. aureus 21189

SEQ ID NO: 33819 - protein, 141 aa, Staphylococcus aureus; identical to SEQ ID NO: 30715
  subsp. aureus 21189

SEQ ID NO: 33820 - protein, 231 aa, Staphylococcus aureus; identical to SEQ ID NO: 31073
  subsp. aureus 21189

SEQ ID NO: 33821 - protein, 2357 aa, Staphylococcus aureus
  subsp. aureus 21189
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGDQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKIDFN

SEQ ID NO: 33822 - protein, 646 aa, Staphylococcus aureus
  subsp. aureus 21189
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSD

SEQ ID NO: 33823 - protein, 434 aa, Staphylococcus aureus [sequence omitted]

SEQ ID NO: 33824 - protein, 927 aa, Staphylococcus aureus
  subsp. aureus 21193
MNMKKKEKHAIRKKSIGVASVLVGTLIGFGLLSSKEADASENSVTQSDSASNESKSNDSSSINAAPKTDNTNVSDTKPTSNTNNGETSVAQNPAQQETTQSASTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSASDSDSASDSDSASDSDSASDSDSASDSDSASDSDSASDSDSASDSDSASDSDSASDSDSASDSDSDSDSDSDSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDNDSDSDSDSESDSDSDSDSDSDSASESDSGSDSDSDSDSDSDSDSDSDSDSDSDSDSDSDSDLDSDSDSDSGSDSESDSDSDSESDSNSDSESGSNNNVVPPNSPKNGTNASNKNEAKDSKEPLPDTGSEDEANTSLIWGLLASLGSLLLFRRKKENKDKK

SEQ ID NO: 33825 - protein, 1022 aa, Staphylococcus aureus
  subsp. aureus 21193
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSAAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSESDSDSDSDSDSDSDSDSDSDSDSDSDSDSDSDSDSDSDSDSDSDSDSDSDSDSDS

SEQ ID NO: 33826 - protein, 157 aa, Staphylococcus aureus
  subsp. aureus 21193
DSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 33827 - protein, 250 aa, Staphylococcus aureus
  subsp. aureus 21193
MGEFEVKYLTGFILILLLEGIFTNSASAIEYSDLHHKSKLNSKRLYNAKVSFANPTDLENKKTNDRLLKHDLLFHDMFVNDDWKKEFKVEFENEALSKKFINKDIDIFAGNYGYGCHGGATNKTQCSYGGVTLSDNNKYDDYKNIPCNLWIDGHQTEIELTAVKTKKKIVTIQELEVQLRNYLNEKYKLYEQGGDIVKGYVKYYNDDEQNVEYDFYNLNGEYGREVLKMYADNKTINSDKLHLDIYLFKS

SEQ ID NO: 33828 - protein, 291 aa, Staphylococcus aureus; identical to SEQ ID NO: 30390
  subsp. aureus 21193

SEQ ID NO: 33829 - protein, 895 aa, Staphylococcus aureus
  subsp. aureus 21193
MNKHHPKLRSFYSIRKSTLGVASVIVSTLFLITSQHQAQAAENTNTSDKISENQNNNATTTQPPKDTNQTQPATQPANTTKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSMINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKITEHLPSDIHKTVDKTVKTKEKAGTPSKENKLSQSKMLPKTGETTSSQSWWGLYALLGMLALFIPKFRKESK

SEQ ID NO: 33830 - protein, 2186 aa, Staphylococcus aureus
  subsp. aureus 21193
MNLLKKNKYSIRKYKIGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDSLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNEEVDQAQQLGTKAINAIQPNIVKKPAALAQINQHYNAKLAEINATPDATNDEKNAAINTLNQDRQQAIESIKKANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHNEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKVIQPAPKVCTPIKKEETHESRKVEKELPNTGSEGMDLPLKEFALITGAALLARRRTKNEKES

SEQ ID NO: 33831 - protein, 331 aa, Staphylococcus aureus
  subsp. aureus 21193
MSNQFKSEEERRQWEQFQAFQNQQNQQHQQYGQKKSKKGWFWGCGGCLVLFILIIIGISACTAGVTGNLGGNSSKEANKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPHSKPTTSEAPPSQNIHNEDSMYDASTE

SEQ ID NO: 33832 - protein, 327 aa, Staphylococcus aureus; identical to SEQ ID NO: 30616
  subsp. aureus 21193

SEQ ID NO: 33833 - protein, 311 aa, Staphylococcus aureus; identical to SEQ ID NO: 30617
  subsp. aureus 21193

SEQ ID NO: 33834 - protein, 258 aa, Staphylococcus aureus; identical to SEQ ID NO: 30410
  subsp. aureus 21193

SEQ ID NO: 33835 - protein, 251 aa, Staphylococcus aureus
  subsp. aureus 21193
MRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEERVIGVNVFKDGVQQEGFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 33836 - protein, 238 aa, Staphylococcus aureus
  subsp. aureus 21193
MLNGNPKPEQLNKASEFTGLMDNMRYLYDDKHVSETNIKSQEKFLQHDLLFKINGSKILKTEFNNKSLSDKYKNKNVDLFGTNYYNQCYFSSDNMELNDGRLIEKTCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 33837 - protein, 242 aa, Staphylococcus aureus; identical to SEQ ID NO: 30399
  subsp. aureus 21193

SEQ ID NO: 33838 - protein, 239 aa, Staphylococcus aureus; identical to SEQ ID NO: 30622
  subsp. aureus 21193

SEQ ID NO: 33839 - protein, 254 aa, Staphylococcus aureus
  subsp. aureus 21193
MLNVLLLILNLIAICSVNNAYANEEDPKIESLCKKSSVDPIALHNINDDYINNRFTTVKSIVSTTEKFLDFDLLFKSINWLDGISAKFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 33840 - protein, 61 aa, Staphylococcus aureus
  subsp. aureus 21193
MRKHLIEKYGLYKTISKDGRVKISLKDGSFYNLDLRSKLKFKYMGEVIESKQIKDIEVNLK

SEQ ID NO: 33841 - protein, 157 aa, Staphylococcus aureus
  subsp. aureus 21193
MKFTALAKATLALGILTTGTLTTEAHSSHAKQNQETVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEK

SEQ ID NO: 33842 - protein, 232 aa, Staphylococcus aureus; identical to SEQ ID NO: 30584
  subsp. aureus 21193

SEQ ID NO: 33843 - protein, 232 aa, Staphylococcus aureus; identical to SEQ ID NO: 30583
  subsp. aureus 21193

SEQ ID NO: 33844 - protein, 231 aa, Staphylococcus aureus
  subsp. aureus 21193
MKLKTLAKATLALGLLTTGVITSEGQAVQAKEKQERVQHLYDIKDLHRYYSSESFEFSNIRGKVENYNGSNVVRFNQDGQNHQLFLLGEDKAKYKQGLQGQDVFVVKELIDPNGRLSTVGGVTKKNNQSSETNTPLVVNKVYGGDLHASINSFSINKEEVSLKELDFKIRKQLVEKYGLYKGTTKYGKITINLKDEKKEVIDLGDKLQFERMGDVLNSKDIQNIAVTINQI

SEQ ID NO: 33845 - protein, 234 aa, Staphylococcus aureus; identical to SEQ ID NO: 33390
  subsp. aureus 21193

SEQ ID NO: 33846 - protein, 276 aa, Staphylococcus aureus
  subsp. aureus 21193
MKITTIAKTSLALGLLTTGVITTTTQAANATTPSSTKVEVPQSTPLSTKVEAPQSKPNATTPPSSNVDTSPPQSPTTKQVPTEINPKFKDLRAYYTKPSIEFKNEIGIILKKWTTIRFMNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 33847 - protein, 356 aa, Staphylococcus aureus
  subsp. aureus 21193
MKMRTIAKTSLALGFLTTGAITVTTQSVKAEKIQSTKVDKVPRLKAERLAMINITTGANSATTQAANTGQERTAKLEKAPNTNEEKTSISKIEKISQPKQVAQKSLNISATPAPKQEQSQTTTESTTLKTKVTTPPSTNTPQPMKSTKSDTPQSPTIKQAQTDITPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKAELSITKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 33848 - protein, 231 aa, Staphylococcus aureus; identical to SEQ ID NO: 30768
  subsp. aureus 21193

SEQ ID NO: 33849 - protein, 226 aa, Staphylococcus aureus
  subsp. aureus 21193
MKFKAIAKASLALGMLATGVITSNVQSVQAKTEVKQQSEADLKLYYSGPSFEHKKVTGFKYTDEKGSFFEFIDRGQFNKVSLVGPDKDKLNDGDNSGLDVFVVREGYGRQADNHSIGGVTKTNRQSYFDQINTPILEIKNDSEDLYKGYHLIFKEDISLKELDYRLRERAIKQHGLYSNGLKQGQITITMKDGKSHTIDLSQKLEKERMGDSIDGRQIQKILVEIK

SEQ ID NO: 33850 - protein, 203 aa, Staphylococcus aureus; identical to SEQ ID NO: 30346
  subsp. aureus 21193

SEQ ID NO: 33851 - protein, 266 aa, Staphylococcus aureus; identical to SEQ ID NO: 30362
  subsp. aureus 21193

SEQ ID NO: 33852 - protein, 691 aa, Staphylococcus aureus
  subsp. aureus 21193
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSRTSQSNDVDKSQPFIPAQKVLPNHDKAAPTSTTPPSNDKTAPKSTKAQDATTDKHPNQQDTHQPAHQITDAKQDDTVRQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 33853 - protein, 241 aa, Staphylococcus aureus
  subsp. aureus 21193
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGINHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 33854 - protein, 452 aa, Staphylococcus aureus
  subsp. aureus 21193
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33855 - protein, 642 aa, Staphylococcus aureus
  subsp. aureus 21193
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRLDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVL

SEQ ID NO: 33856 - protein, 2275 aa, Staphylococcus aureus
  subsp. aureus 21193
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESISSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPKSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSILTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESISESTSESVSSSTSASTSLSDSTSESGSTSTSLSNSTSGSASISTSTSNSESTSTFKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSMSRSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSMSISDSMSVSVSLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISVSTSLSDSSSTSTSESLSDSMSQSQSTSTSASGSLSTSISTSMSMSASTSTSQSTSVSTSLSTSDSISDSTSISIRGSQSTVESESTSDSTSISDSESLSTSGSDSTSTSTSDSTSGSTSTSTSESLSTSGSGSTSVSDSTSMSESDSTSDSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTSAQSEKRLPDTGDSIKQNGLLGGVMTLLVGLGLMKRKKKKDENDQDDSQA

SEQ ID NO: 33857 - protein, 846 aa, Staphylococcus aureus
  subsp. aureus 21193
MIETPQLNTTANDTSDISANTISANVDSTAKPMSTQTSNTTTTEPASTNETPQPTAIKDQATAAKMQDQTVPQEANSQVDNKTTNDANSIATNSELKNPQTLDLLQSSPQTISNAQGTSKPSVRTRAVRSLAVAEPVVNAADAKGTNVNDKVTASNLQLQKTTFDPNQSGNTFMAVNFKVAGKVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPEPEPTPDPEPSPDPDPDSDSDSDSDSDSDSESDSDSDSDSESDSDSDSGSDSDSDSDSDSGSDSDSDSDSDSESDSDSDSDSDSESDSDSDSDSESDSDSDSDSDSDSDSDNDSESDSDSDSDSDSDSDSDSDSDSDSESDSDSESDSESDSDSDSDSDSDSDSDSDSDSDSDSESDSDSDSDSDSDSDSDSESDSDSDSDSDSDSDSDSDSDSDSDSDSDSDSDSDSESDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 33858 - protein, 178 aa, Staphylococcus aureus
  subsp. aureus 21193
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKR

SEQ ID NO: 33859 - protein, 961 aa, Staphylococcus aureus
  subsp. aureus 21193
MNNKKTVTNRKGIIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSKTNTTTYTFTNYVDQYTNVSGSIEQVAFAKRENATTDKTAYKMEVTLGNDKYSKDVIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 33860 - protein, 321 aa, Staphylococcus aureus
  subsp. aureus 21193
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKIKKVKD

SEQ ID NO: 33861 - protein, 338 aa, Staphylococcus aureus; identical to SEQ ID NO: 31292
  subsp. aureus 21193

SEQ ID NO: 33862 - protein, 330 aa, Staphylococcus aureus; identical to SEQ ID NO: 30381
  subsp. aureus 21193

SEQ ID NO: 33863 - protein, 477 aa, Staphylococcus aureus
  subsp. aureus 21193
MKFKSLITTTLALGVIASTGANFNTNEASAAAKPLDKSSSTLHHGHSNIQIPYTITVNGTSQNILSSLTFNKNQNISYKDIENKVKSVLYFNRGISDIDLRLSKQAEYTVHFKNGTKRVIDLKSGIYTADLINTSDIKAISVNVDTKKQPKDKAKANVQVPYTITVNGTSQNILSNLTFNKNQNISYKDLEGKVKSVLESNRGITDVDLRLSKQAKYTVNFKNGTKKVIDLKAGIYTANLINSSDIKSININLDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKNK

SEQ ID NO: 33864 - protein, 96 aa, Staphylococcus aureus; identical to SEQ ID NO: 31559
  subsp. aureus 21193

SEQ ID NO: 33865 - protein, 226 aa, Staphylococcus aureus
  subsp. aureus 21193
MKLKNIAKASLALGILTTGMITTTAQPVKASTLEVRSQATQDLSEYYNRPYFDLRNLSGYREGNTVTFINHYQQTDVKLEGKDKDKIKDGNNENLDVFVVREGSGRQADNNSIGGITKTNRTQHIDTVQNVNLLVSKSTGQHTTSVTSTNYSIYKEEISLKELDFKLRKHLIDKHDLYKTEPKDSKIRVTMKNGDFYTFELNKKLQTHRMGDVIDGRNIEKIEVNL

SEQ ID NO: 33866 - protein, 808 aa, Staphylococcus aureus
  subsp. aureus 21193
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPVKKLEKLKTNFSKSAPQKNTNLNWWDYEIGTPRALTNTLILLKEDFTDEEKKKYTAPIKTFAPKSDEILSSVGKAEPAKGGNLVDIAKVKLLESIIEEDKDMTKNSIDAFNKVFTYVQSNASGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDESTKAKYKKIVKSSVESDSSYKQNDYLNSYSDIDKMKSLMDDSTISTNGLTQQLKIYNDMDRVTYHNKDLDFAFGLSMTSKNVARYESINGENLKGWHTGAGMSYLYNSDVKHYRDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQGTNSVFLESTDTKKNIGYHFLNESKITVKKESHTGKWSDINKSQKQDSKTNQYYEVTQKHSNTDSKYAYVLYPGLSKDDFNTKKDKVTVVKQNDDFHVVKDNESVWAGVNYSDSTQTFIINNTKVEVKAKGMFVLKKKDDNTYECSFYNPESTNSTSDIESKISMTGYSITNKNTSTSNESGVRFELTK

SEQ ID NO: 33867 - protein, 247 aa, Staphylococcus aureus; identical to SEQ ID NO: 33631
  subsp. aureus 21193

SEQ ID NO: 33868 - protein, 321 aa, Staphylococcus aureus; identical to SEQ ID NO: 30959
  subsp. aureus 21193

SEQ ID NO: 33869 - protein, 315 aa, Staphylococcus aureus; identical to SEQ ID NO: 30573
  subsp. aureus 21193

SEQ ID NO: 33870 - protein, 325 aa, Staphylococcus aureus
  subsp. aureus 21193
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWRVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 33871 - protein, 873 aa, Staphylococcus aureus
  subsp. aureus 21193
MGQEKEAAASEQNNTTVEESGSSATESKASETQTTTNNVNTIDETQSYSATSTEQPSQSTQVTTEEAPKTVQAPKVETSRVDLPSEKVADKETTGTQVDTAQPSNVSEIKPRVKRSTDVAVVAGEAKATGTDVTNKVTVENGSEIVGHKQDMNVVNPHNAERVTLKYKWKFGEGIKEGDYFDFTLSDNVETHGISTLRKVPEIKSSTEDKVMANGQVIDERKIRYTFTDYINSKKDLTAELNLNLFIDPTTVTKQGKQNVKVTLGNKEIEKEFDIKYLYGVKDRMGVTVNGRIHTLNKEEGRFSHFAYVKPNNQSLTSVTVSGQVTKGNKSGASNPSVKVYKHIGSDELAESVYAKLDDANKFEDVTNKVNLSYTGDGGYSLDFSDLDNSKDYVIKYEGEYDQNAKDLNFRTHLSGYHKNYPYYPNYYYPVQLTWNNGVAFYSNNAQGDGKDKPKEPIIEHSTPIELEFKSEPPVEKHELTGTIEESNDSKPIDFEYHTAVEGAEGHVEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHSNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSVQNEGQQTIEEDTTPPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 33872 - protein, 992 aa, Staphylococcus aureus
  subsp. aureus 21193
MIVVGMGQDKEAAASEQKTTVEENGNSATDNKVSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGQETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTNEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTRGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNIVDFEEDTLPKVSGQNEGQQTIEEDTTPPTPPTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 33873 - protein, 233 aa, Staphylococcus aureus; identical to SEQ ID NO: 30428
  subsp. aureus 21193

SEQ ID NO: 33874 - protein, 89 aa, Staphylococcus aureus
  subsp. aureus 21193
DSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 33875 - protein, 434 aa, Staphylococcus aureus [sequence omitted]

SEQ ID NO: 33876 - protein, 231 aa, Staphylococcus aureus; identical to SEQ ID NO: 33623
  subsp. aureus 21193

SEQ ID NO: 33877 - protein, 1926 aa, Staphylococcus aureus
  subsp. aureus 21193
MNLFRQQKFSIRKFNVGIFSALIATVTFISINPTTASAAEQNQPAQNQPAQPADANAQPNANAGAQANPAAQPAAPANQGQPAAQPANQGGQANPAGGTAQPAGGAAQPAAGTAQPAGQGNQADPNNAAQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKSDQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQTDIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIGAATTNAQVEAIKTKAINDINQTTPATTAKAAALEEFDEVVQAQIDQAPLNPDTTNEEVAEAIERINAAKVSGVKAIETTMTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDTANSNSEVATAKDNGIAAINQVQAATTKKSDAKAEIAQKASERKTAIEAMNDSTTEEQQAAKDKVDQAVVTANADIDNAAANADVDNAKTTNEATIAAITPDANVKPAAKQAIADKVQAQETAINANNGSTTEEKEAAKQQVQTEKTTADTAIDGAHSNAEVEAAKNAEIAKIEAIQPATTTKDDAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAAITNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKLNAKNDVDQAVTTQNQAIDNTTGATTEEKNAAKDLVLKAKEKAYLDILNAQTTNDVTQIKDQAVTDIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTENKKLSKN

SEQ ID NO: 33878 - protein, 241 aa, Staphylococcus aureus; identical to SEQ ID NO: 31311
  subsp. aureus 21193

SEQ ID NO: 33879 - protein, 241 aa, Staphylococcus aureus
  subsp. aureus 21193
MNNNITKKIILSTTLLLLGTASTQFPNTPINSSSEAKAYYINQNETNVNELTKYYSQKYLTFSNSTLWQKDNGTIHATLLQFSWYSHIQVYGPESWGNINQLRNKSVDIFGIKDHETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 33880 - protein, 238 aa, Staphylococcus aureus
  subsp. aureus 21193
MCKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 33881 - protein, 148 aa, Staphylococcus aureus
  subsp. aureus 21193
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFYW

SEQ ID NO: 33882 - protein, 172 aa, Staphylococcus aureus
  subsp. aureus 21193
MDFTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 33883 - protein, 165 aa, Staphylococcus aureus; identical to SEQ ID NO: 31315
  subsp. aureus 21193

SEQ ID NO: 33884 - protein, 109 aa, Staphylococcus aureus; identical to SEQ ID NO: 30603
  subsp. aureus 21193

SEQ ID NO: 33885 - protein, 350 aa, Staphylococcus aureus
  subsp. aureus 21193
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTETTKDQTKTQTAHTVKTAQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 33886 - protein, 641 aa, Staphylococcus aureus
  subsp. aureus 21193
MNKQQKEFKSFYSIRKSSLGVASVAISTLLLLMSNGEAQAAEETGGTNTEAQPKTEAVASPTTTTEKAPEAKPVANAVSVSNKEVEAPTSETKEAKEVKAPKETKAVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVAKPTTASSKTTKDVVQTSASSSEAKDSAPLQKANIKNTNDGHTQSQNNKNTQENKAKSLPQTGEESNKDMTLPLMALLALSSIVAFVLPRKRKN

SEQ ID NO: 33887 - protein, 218 aa, Staphylococcus aureus
  subsp. aureus 21194
MIKKTDTRTINVAVEPGYKSLTTKVHIVVPQINYNHRYTTHLEFEKAIPTLADAAKPNNVKPVQPKPAQPKTPTEQTKPVQPKVEKVKPAVTAPSKAENTQTTKVVSTEATKDQSQTHSARTVKTTQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 33888 - protein, 644 aa, Staphylococcus aureus
  subsp. aureus 21194
MNKQQKEFKSFYSIRKSSLGVASVAISTLLLLMSNGEAKAAEETGGTITETQPKTEAVASPTTTTEKAPEAKPVANAVSVSNKEVVAPTTETKEAKEVKEVKAPNETKEVKPAAKSDNNTYPILNEELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDELPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGERVRTISKDAKNNTRTIIFPYVEGKTLYDAIVKVHVKTIDYDGQYHVRIVDKEAFTKANADKSNKKEQQDNSAKKETTPATPSKPTTAPVEKESQKQDSQKDDNKQSPSVEKEIDASSESGKDKTPATKPAKGEVESSSTTPTKVVSATQNVAKPTSASSETTKGVVQTSAGSSEAKDNAPLQKANIKNTNDGHTQSQNNKNTQENKAKSLPQTGEESNKDMTLPLMALLALSSIIAFVLPRKRKN

SEQ ID NO: 33889 - protein, 1075 aa, Staphylococcus aureus
  subsp. aureus 21194
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNGEIIATAKHDTANNLITYTFTDYVDRFNSVQMGINYSIYMDADTIPVSKNDVEFNVTIGNDTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPLGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLT

SEQ ID NO: 33890 - protein, 129 aa, Staphylococcus aureus
  subsp. aureus 21194
DSDSDSDSDSDSDSDSDSDSDSDSDSDSDSDSDSDSDSDSDSDSDSDSDSDSDSDSDSDSDSDSDSDSNAGKHTPAKPMSAVKDHNNKAKALPETGTENNNSNNGTLFGGLFAALGSLLLFGRRKKQNK

SEQ ID NO: 33891 - protein, 274 aa, Staphylococcus aureus; identical to SEQ ID NO: 30872
  subsp. aureus 21194

SEQ ID NO: 33892 - protein, 339 aa, Staphylococcus aureus; identical to SEQ ID NO: 32812
  subsp. aureus 21194

SEQ ID NO: 33893 - protein, 351 aa, Staphylococcus aureus; identical to SEQ ID NO: 32811
  subsp. aureus 21194

SEQ ID NO: 33894 - protein, 689 aa, Staphylococcus aureus; identical to SEQ ID NO: 32816
  subsp. aureus 21194

SEQ ID NO: 33895 - protein, 241 aa, Staphylococcus aureus; identical to SEQ ID NO: 32827
  subsp. aureus 21194

SEQ ID NO: 33896 - protein, 1837 aa, Staphylococcus aureus
  subsp. aureus 21194
MNLLKKNKYSIRKYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLAANNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAILGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNDMNVTYDATNRVITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSATGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQNIDNTTQDAAVNDVRNQTIKAIEQIKPKVRRKRAALDNIDESNNNQLAAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEAT

SEQ ID NO: 33897 - protein, 681 aa, Staphylococcus aureus; identical to SEQ ID NO: 32855
  subsp. aureus 21194

SEQ ID NO: 33898 - protein, 809 aa, Staphylococcus aureus
  subsp. aureus 21194
MNKNVLKFMVFIMLLNIITPLFNKNEAFAARDISSTNVTDLTVSTSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGQSAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKAIKYLVKEVNAQGEDTTPEGYTKKENGLVVTNTEKPIETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTAILNESNNWTHTWTGLDEKAKGQQVKYTVDELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 33899 - protein, 891 aa, Staphylococcus aureus; identical to SEQ ID NO: 32839
  subsp. aureus 21194

SEQ ID NO: 33900 - protein, 258 aa, Staphylococcus aureus; identical to SEQ ID NO: 30410
  subsp. aureus 21194

SEQ ID NO: 33901 - protein, 256 aa, Staphylococcus aureus
  subsp. aureus 21194
MKLFAFIFICVKSCSLLFMLNGNPKPEQLNKASEFTGLMDNMRYLYDDKHVSETNIKSQEKFLQHDLLFKINGSKILKTEFNNKSLSDKYKNKNVDLFGTNYYNQCYFSSDNMELNDGRLIEKMCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 33902 - protein, 251 aa, Staphylococcus aureus; identical to SEQ ID NO: 30946
  subsp. aureus 21194

SEQ ID NO: 33903 - protein, 214 aa, Staphylococcus aureus
  subsp. aureus 21194
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMFGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVS

SEQ ID NO: 33904 - protein, 239 aa, Staphylococcus aureus; identical to SEQ ID NO: 32822
  subsp. aureus 21194

SEQ ID NO: 33905 - protein, 129 aa, Staphylococcus aureus
  subsp. aureus 21194
MDTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 33906 - protein, 141 aa, Staphylococcus aureus; identical to SEQ ID NO: 32806
  subsp. aureus 21194

SEQ ID NO: 33907 - protein, 291 aa, Staphylococcus aureus; identical to SEQ ID NO: 30390
  subsp. aureus 21194

SEQ ID NO: 33908 - protein, 1783 aa, Staphylococcus aureus
  subsp. aureus 21194
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAAGTTQPAAGTTQPAGQGNQADPNNAVQAQPGNQAAPANQAGQGNNQATPNNAAPANQTQPANAPAAAQPAAPVAANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYAD

SEQ ID NO: 33909 - protein, 331 aa, Staphylococcus aureus; identical to SEQ ID NO: 32807
  subsp. aureus 21194

SEQ ID NO: 33910 - protein, 762 aa, Staphylococcus aureus
  subsp. aureus 21194
MNNKKTAINRKGMIPNRLNKFSIRKYSVGTASILVGTTLIFGLSGHEAKAAEHTNGELNQSKNETTDSSENKTTEKVDSRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDADNWTLDSGFYKTPKYSLGDYVWYDSNKDGKQDSTEKGIKGVKVTLQNEKGEVIGTTETDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDSDSA

SEQ ID NO: 33911 - protein, 109 aa, Staphylococcus aureus; identical to SEQ ID NO: 30603
  subsp. aureus 21194

SEQ ID NO: 33912 - protein, 102 aa, Staphylococcus aureus
  subsp. aureus 21194
SDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 33913 - protein, 233 aa, Staphylococcus aureus; identical to SEQ ID NO: 32856
  subsp. aureus 21194

SEQ ID NO: 33914 - protein, 133 aa, Staphylococcus aureus
  subsp. aureus 21194
DSDSDSDSDSDSDSDSDSDSDSDSDSDSNSDSDSDSDSDSDSDSDSDSDSDSDSDSDSDSDSDSDSESDSDSDTGKHTPVKPMSTTKDHHNKAKALPETGSENNGSNNATLFGGLFAALGSLLLFGRRKKQNK

SEQ ID NO: 33915 - protein, 953 aa, Staphylococcus aureus
  subsp. aureus 21194
MNYRDKIQKFSIRKYTVGTFSTVIATLVFLGLNTSHAQAAETNQLASVLKQKQQNGDAQTENRESQTQNSQNSQNGQSLSAPIENEQPNNNQTNQVDASGAQPYTTKHDQPVSQNEQAKKDTADATQTQSAKAESKHEQNESRSANKKGNDNNATHVENHEANVVTASDSSDSGSVQHDRNELQAFFDANYHDYRFIDRENADSGTFNYVKGIFDKNNTLLGSNDPINNKDLQVAYKELEQAVALIRTMPQRQQTSRRSSRIQTRSIESRSAEPRSVSSYQNADSSYYVENANDGSGYPVGTYINASNKGAPYNLPTTPWNTLKASAAKEIALITAKQTGDGYQWVIKFNKGHAPHENMIYWFALPADQVPVGRTDFVTVNADGTNVQWSNGAGAGANKPLPQMWPNGVNDSRSWDFKIRNRSGQVIYDWPTVHINSLKDLARAGDYFSEAGAPASTKAFGRQIFEYINGERPTESPGVPRVYTFIGKGDASYTISFKTQGPTIDKLYYAAGGRALEYNQLFMYSQLYVESTQDQQQRLNGLRQTVNRTYRLGTTKRVEISHGNVQTKKVLESSNLNIDDFIDDPLSYVKTPSNKVLGFYPTNANPNVRRPGGVQELNEYQISQLFTDDKLQQAARNRTPIQLMIGFDYPDGHGNAETLVPVNLTVLPEIQHNIKFFKNDDGQNIADKPASKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTITTTAEQLRGTALQKVPVTVSGVPLDPSALVYLVIPTSQTRDGGSEADQIPSGYTKIATGTPDGVHSTITIRPEDYVVFIPPVGHQIRALIYYNNVVASNMSNAVTILPDDIPPTINNPVGLNAKYYRGDEVSFTMGVSDRHSGIKSTTITTLPS

SEQ ID NO: 33916 - protein, 101 aa, Staphylococcus aureus
  subsp. aureus 21194
KEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 33917 - protein, 165 aa, Staphylococcus aureus; identical to SEQ ID NO: 32831
  subsp. aureus 21194

SEQ ID NO: 33918 - protein, 319 aa, Staphylococcus aureus
  subsp. aureus 21194
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKATKQQTNIDVIYERVRDDYQLHWTSTNWKGTNTKDKWTDRCSERYKIDWEKEEMTN

SEQ ID NO: 33919 - protein, 238 aa, Staphylococcus aureus; identical to SEQ ID NO: 32829
  subsp. aureus 21194

SEQ ID NO: 33920 - protein, 173 aa, Staphylococcus aureus
  subsp. aureus 21194
GKGNGTIHATLLQLSWFSHIQVFGPESWGNINQLRNKYVDIFALKDYETWHTYMLAQETFTGGVTPAAKPSDKHYKLNLTYKDKSGTFIGEHPFYTGNKPVLTLKEVDFRIRQTLIKNKKLYHGNYNKGHIKITGGSNNYTIDLNKRLKSTDANRYVKNPQTAHIEILLEKSN

SEQ ID NO: 33921 - protein, 707 aa, Staphylococcus aureus
  subsp. aureus 21194
MWESSKDIDTKSADMTRTYRNIEKIAEAMNHPKTTLKNDENKKKLKDALEWLHKNAYGKDPDKKVADLKTNFSKSAPQKNTNLNWWDYEIGTPKSLTNTLILLNGDISSDEKKKYTAPIKTFAPKSDEILSSVGKAEPAKGGNLVDIAKVKLLESIIEEDKDMTKNSIDSFNKVFTYVQSNSTGKERNGFYKDGSYIDHQDVPYTGAYGVVLLEGISQMMPMIKETPFKETSQNDTILKSWIDDGFMPLIYKGEMMDLSRGRAISRENETSHSASVTVMKSLLRLSDAMDESTKAKYKKIVKTSVKSDSSYKQNDYLSSYSDISKMKALMEDSTLSTNDLTQQLKIYNDMDRVTYHNKDLDFAFGLSMTSKNVARYESINNENLKGWHTGAGMSYLYNSDVKHYRDNFWATADMKRLAGTTTLDNEEPKENKNSDKTFVGGTKFDDQHASIGMEFENQDKTLTAKKSYFILNDKIVFLGTGIKNTDSSMNPVTTIENRKANGYTLYTDDKQTTNSDNQETNSVFLESTDTKKNIGYHFLNKSKINVKKESHTGKWSEINKSQKTEDKKDEYYEVTQKHSNSDNKYGYVLYPSLSKDVFKSKASQVTVVKQDDDFHVVKDNESVWAGVNYSDSAKTFEINGTKVEVKAKGMFILKKKDDKTYECSFYNPESTNTASDIESKISMTGYSITNKNASTTNESGVRFELTK

SEQ ID NO: 33922 - protein, 704 aa, Staphylococcus aureus
  subsp. aureus 21194
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPEPSPDPDPDSDSDSDSDSGSDSDSDSESDSDSDSDSGSDSDSDSESDSDSDSDSDSDSDSDSDSDSDSDSDSDSDSDSDSDSDSDSDSDSDSDS

SEQ ID NO: 33923 - protein, 2273 aa, Staphylococcus aureus
  subsp. aureus 21194
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTFSKNTTSSSDTKSVASTSSTEQPINTSTNQSTASNNTSQSTTPSSANLNKTSTTSTSTAPVKIRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNALAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 33924 - protein, 241 aa, Staphylococcus aureus; identical to SEQ ID NO: 32842
  subsp. aureus 21194

SEQ ID NO: 33925 - protein, 639 aa, Staphylococcus aureus
  subsp. aureus 21194
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSTSDSDSASDSDSASDSDSDSDSDSNSDSDSDSDSDS

SEQ ID NO: 33926 - protein, 434 aa, Staphylococcus aureus [sequence omitted]

SEQ ID NO: 33927 - protein, 278 aa, Staphylococcus aureus
  subsp. aureus 21194
MNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKD

SEQ ID NO: 33928 - protein, 920 aa, Staphylococcus aureus
  subsp. aureus 21194
MKNNLRYGIRKHKLGAASVFLGTMIVVGMGQDKEAAASEQKTTTVEENGNSTTDNKVSETQTTTTNVNHIEETQSYNATVTEQPSNATQVTTEEAPKAVQAPQTAQPANVEKVKEEVVKEEAKPQVKETTQSQDNSGDQRQVDLIPKKATQNQVAETQVEVAQPRTVSESKPRVTRSADVVEAKEGMGVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTNEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHANVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPGEPTPPTPEVPSEPETPTPPTPEVPSRARNTNATDT

SEQ ID NO: 33929 - protein, 137 aa, Staphylococcus aureus
  subsp. aureus 21194
PTPEVPSEPETPTPPTPEVPSEPETPTPPTPEVPSEPETPTPPTPEVPAEPGKPVPPAKEEPKKPSKPVEQGKVVTPVIEINEKVKPVAPTKQKQSKKSELPETGGEESTNKGMLFGGLFSILGLALLRRNKKNHKA

SEQ ID NO: 33930 - protein, 250 aa, Staphylococcus aureus; identical to SEQ ID NO: 32837
  subsp. aureus 21194

SEQ ID NO: 33931 - protein, 231 aa, Staphylococcus aureus
  subsp. aureus 21194
MKKTLLASSLAVGLGIVAGNAGHEAHASEADLNKASLAQMAQSNDQTLNQKPIEAGAYNYTFDYEGFTYHFESDGTYFAWNYHATGANGADMSAQAPATNNVAPSADQANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 33932 - protein, 691 aa, Staphylococcus aureus; identical to SEQ ID NO: 32852
  subsp. aureus 21194

SEQ ID NO: 33933 - protein, 55 aa, Staphylococcus aureus
  subsp. aureus 21194
MSKGDIVINTKDGGKYTLESHKELQKNRENVKINTADVKNVTFELVKSVNDIEQV

SEQ ID NO: 33934 - protein, 266 aa, Staphylococcus aureus; identical to SEQ ID NO: 30401
  subsp. aureus 21194

SEQ ID NO: 33935 - protein, 231 aa, Staphylococcus aureus; identical to SEQ ID NO: 32843
  subsp. aureus 21194

SEQ ID NO: 33936 - protein, 227 aa, Staphylococcus aureus; identical to SEQ ID NO: 32844
  subsp. aureus 21194

SEQ ID NO: 33937 - protein, 232 aa, Staphylococcus aureus
  subsp. aureus 21194
MKLTVLAKATLALGILTTGVMTAESQTVHAKVKLDETQRQYYINMLKDYYSQESYESTNISVKSEDYYGSNVLNFNQRNKNFKVFLIGDDRNKYKELMHGRDVFAVPELIDTKGGIYTVGGITKKNVRSVFGYVSHPGLQVKKVDPKDGFSIKELFFIQKEEVSLKELDFKIRKMLVEKYRLYKGASDKGRIVINMKDEKKHEIDLSEKLSFDRMFDVIDSKQIKNIEVNLN

SEQ ID NO: 33938 - protein, 231 aa, Staphylococcus aureus
  subsp. aureus 21194
MKLKTLAKATLALGLLTTGVITSEGQAVKAAEKQERVQHLYDIKDLHRYYSAPSFEYSNISGKVENYNGSNVVRFNQKDQNHQLFLLGKDKDKYKEGLQGQNVFVVQELIDPNGRLSTVGGVTKSNNKTSETKTQLVVNKVDGGNLDASIDSFLIQKEEISLKELDFKIRKQLVENYGLYQGTSKYGKIIINLKDEKREVIDLSDKLEFERMGDVLNSKDIRGIAVTINQI

SEQ ID NO: 33939 - protein, 234 aa, Staphylococcus aureus; identical to SEQ ID NO: 32846
  subsp. aureus 21194

SEQ ID NO: 33940 - protein, 282 aa, Staphylococcus aureus; identical to SEQ ID NO: 32847
  subsp. aureus 21194

SEQ ID NO: 33941 - protein, 343 aa, Staphylococcus aureus; identical to SEQ ID NO: 32848
  subsp. aureus 21194

SEQ ID NO: 33942 - protein, 233 aa, Staphylococcus aureus; identical to SEQ ID NO: 32849
  subsp. aureus 21194

SEQ ID NO: 33943 - protein, 226 aa, Staphylococcus aureus; identical to SEQ ID NO: 32850
  subsp. aureus 21194

SEQ ID NO: 33944 - protein, 325 aa, Staphylococcus aureus; identical to SEQ ID NO: 32859
  subsp. aureus 21194

SEQ ID NO: 33945 - protein, 315 aa, Staphylococcus aureus; identical to SEQ ID NO: 30183
  subsp. aureus 21194

SEQ ID NO: 33946 - protein, 309 aa, Staphylococcus aureus
  subsp. aureus 21194
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 33947 - protein, 896 aa, Staphylococcus aureus
  subsp. aureus 21194
MINRDNKKAITKKGMISNRLNKFSIRKYTVGTASILVGTTLIFGLGNQEAKAAENTSTENAKQDDATTSDNKEVVSETENNSTTENNLTNPIKKETNTDSQQEAKEAPTTSSTQQQQNNATTSTETRPQNIEKENVQPSTDKTATEDTSVILEEKKAPNNTNNDVTTKPSTSEIQTTPTTPQESTKIENSQPQATPSKVDNQVTDATNPKESVNVSKEELKNNPEKLKELVRNDSNTDRSTKPVAIAPTSVTPKRVNAKMRFAVAQPAAVASNNVNDLIKVTKQTIKVGDDEDNVVSAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDTTEKGIKDVTVTLQNEKGEVIGTTKTDENGKYRFDNLDSGKYKVIFEKPAGLT

SEQ ID NO: 33948 - protein, 151 aa, Staphylococcus aureus
  subsp. aureus 21194
DSDSDSDSDSDSDSDSDSDSDSDSDSDSGSDSDSDSDSDSDSDSDSDSDSDSDSDSDSDSDSDSDSDSDSDSDSDSDSDSDSDSDSDSDSDAGKHTPVKPMSATKDHHKKAKALPETGSENNGSNNATLFGGLFAALGSLLLFGRRKKQNK

SEQ ID NO: 33949 - protein, 689 aa, Staphylococcus aureus; identical to SEQ ID NO: 31861
  subsp. aureus 21195

SEQ ID NO: 33950 - protein, 372 aa, Staphylococcus aureus
  subsp. aureus 21195
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVPSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 33951 - protein, 967 aa, Staphylococcus aureus
  subsp. aureus 21195
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDFRQRSDSDSDSDSDSDS

SEQ ID NO: 33952 - protein, 145 aa, Staphylococcus aureus
  subsp. aureus 21195
DSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 33953 - protein, 284 aa, Staphylococcus aureus
  subsp. aureus 21195
MKFLHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 33954 - protein, 714 aa, Staphylococcus aureus
  subsp. aureus 21195
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSGQR

SEQ ID NO: 33955 - protein, 434 aa, Staphylococcus aureus [sequence omitted]

SEQ ID NO: 33956 - protein, 788 aa, Staphylococcus aureus
  subsp. aureus 21195
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGN

SEQ ID NO: 33957 - protein, 115 aa, Staphylococcus aureus
  subsp. aureus 21195
TAIQNRTSDSDSDSDSDSDSESDSDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 33958 - protein, 639 aa, Staphylococcus aureus; identical to SEQ ID NO: 33715
  subsp. aureus 21195

SEQ ID NO: 33959 - protein, 232 aa, Staphylococcus aureus; identical to SEQ ID NO: 31257
  subsp. aureus 21195

SEQ ID NO: 33960 - protein, 227 aa, Staphylococcus aureus; identical to SEQ ID NO: 30564
  subsp. aureus 21195

SEQ ID NO: 33961 - protein, 232 aa, Staphylococcus aureus; identical to SEQ ID NO: 30565
  subsp. aureus 21195

SEQ ID NO: 33962 - protein, 231 aa, Staphylococcus aureus; identical to SEQ ID NO: 30566
  subsp. aureus 21195

SEQ ID NO: 33963 - protein, 234 aa, Staphylococcus aureus; identical to SEQ ID NO: 30567
  subsp. aureus 21195

SEQ ID NO: 33964 - protein, 325 aa, Staphylococcus aureus
  subsp. aureus 21195
MKMTQIAKTSLALSLLTTGASIVTTQSANAEVASALKTEQAIKSKIQKVTTSPSTKVKATQPTPSVTTTTPPSPNVQPQSPQPTPSVTTPPSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 33965 - protein, 343 aa, Staphylococcus aureus; identical to SEQ ID NO: 31263
  subsp. aureus 21195

SEQ ID NO: 33966 - protein, 233 aa, Staphylococcus aureus; identical to SEQ ID NO: 31264
  subsp. aureus 21195

SEQ ID NO: 33967 - protein, 226 aa, Staphylococcus aureus; identical to SEQ ID NO: 31265
  subsp. aureus 21195

SEQ ID NO: 33968 - protein, 2189 aa, Staphylococcus aureus
  subsp. aureus 21195
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKHTQFIIDEILAIKLPAEVIKASPKVGKTAPKVCTPIKKEDKQEVRKVVKELPNTGSEEMDLPLKELALITGAALLARRRSKKEKES

SEQ ID NO: 33969 - protein, 331 aa, Staphylococcus aureus; identical to SEQ ID NO: 31235
  subsp. aureus 21195

SEQ ID NO: 33970 - protein, 474 aa, Staphylococcus aureus
  subsp. aureus 21195
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARY

SEQ ID NO: 33971 - protein, 316 aa, Staphylococcus aureus
  subsp. aureus 21195
MSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 33972 - protein, 258 aa, Staphylococcus aureus; identical to SEQ ID NO: 30518
  subsp. aureus 21195

SEQ ID NO: 33973 - protein, 165 aa, Staphylococcus aureus
  subsp. aureus 21195
MKVEFNSSDLANQFKGKNIDIYGLYYGNKCVGLTEEKTSCLYGGVTIYDGNQLDEERVIGVNVFKDGIQQEGFVIKTKKAKVTVQELDTKVRFKLENLYKIYNKDTGNIQKGCIFFHSNNHQNQSFYYDLYNIKGSVGAEFFQFYSDNRTVSSSNYHIDVFLYKD

SEQ ID NO: 33974 - protein, 243 aa, Staphylococcus aureus
  subsp. aureus 21195
MLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVFENERNSLSFDIPTNKKNITAQEIDYKVRNYLLKHKNLYEFNSSPYETGYIKFIEGNGHSFWYDMMPESGEKFYPTKYLLIYNDNKTVESKSINVEVHLTKK

SEQ ID NO: 33975 - protein, 242 aa, Staphylococcus aureus; identical to SEQ ID NO: 30522
  subsp. aureus 21195

SEQ ID NO: 33976 - protein, 239 aa, Staphylococcus aureus; identical to SEQ ID NO: 30171
  subsp. aureus 21195

SEQ ID NO: 33977 - protein, 254 aa, Staphylococcus aureus; identical to SEQ ID NO: 31226
  subsp. aureus 21195

SEQ ID NO: 33978 - protein, 231 aa, Staphylococcus aureus; identical to SEQ ID NO: 31216
  subsp. aureus 21195

SEQ ID NO: 33979 - protein, 62 aa, Staphylococcus aureus; identical to SEQ ID NO: 31886
  subsp. aureus 21195

SEQ ID NO: 33980 - protein, 167 aa, Staphylococcus aureus; identical to SEQ ID NO: 31885
  subsp. aureus 21195

SEQ ID NO: 33981 - protein, 291 aa, Staphylococcus aureus; identical to SEQ ID NO: 30390
  subsp. aureus 21195

SEQ ID NO: 33982 - protein, 221 aa, Staphylococcus aureus; identical to SEQ ID NO: 31036
  subsp. aureus 21195

SEQ ID NO: 33983 - protein, 223 aa, Staphylococcus aureus
  subsp. aureus 21195
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNA

SEQ ID NO: 33984 - protein, 165 aa, Staphylococcus aureus; identical to SEQ ID NO: 31241
  subsp. aureus 21195

SEQ ID NO: 33985 - protein, 319 aa, Staphylococcus aureus
  subsp. aureus 21195
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKATKQQTNIDVIYERVRDDYQLHWTSTNWKGTNTKDKWTDRSSERYKIDWEKEEMTN

SEQ ID NO: 33986 - protein, 808 aa, Staphylococcus aureus; identical to SEQ ID NO: 31215
  subsp. aureus 21195

SEQ ID NO: 33987 - protein, 141 aa, Staphylococcus aureus; identical to SEQ ID NO: 31214
  subsp. aureus 21195

SEQ ID NO: 33988 - protein, 241 aa, Staphylococcus aureus; identical to SEQ ID NO: 31173
  subsp. aureus 21195

SEQ ID NO: 33989 - protein, 241 aa, Staphylococcus aureus; identical to SEQ ID NO: 31239
  subsp. aureus 21195

SEQ ID NO: 33990 - protein, 238 aa, Staphylococcus aureus; identical to SEQ ID NO: 31240
  subsp. aureus 21195

SEQ ID NO: 33991 - protein, 351 aa, Staphylococcus aureus
  subsp. aureus 21195
MKNKKRVFIASSLSCALLLLSAANTEANSANKDSQDQTKKEHVDKAQQKEKRNVNDKDKNTPGPDDIGKNGKVTKRTVSEYDKETNILQNLQFDFIDDPTYDKNVLLVKKQGSIHSNLKFESHRNETNASWLKYPSEYHVDFQVQRNPKTEILDQLPKNKISTAKVDSTFSYSLGGKFDSTKGIGRTSSNSYSKSISYNQQNYDTIASGKNNNRHVHWSVVANDLKYGNEIKNRNDEFLFYRNTRLSTVENPELSFASKYRYPALVRSGFNPEFLTYISNEKSNEKTRFEVTYTRNQDILKNKPGIHYGQPILEQNKDGQRFIVVYEVDWKNKTVKVVEKYSDQNKPYKEG

SEQ ID NO: 33992 - protein, 339 aa, Staphylococcus aureus; identical to SEQ ID NO: 31219
  subsp. aureus 21195

SEQ ID NO: 33993 - protein, 274 aa, Staphylococcus aureus
  subsp. aureus 21195
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 33994 - protein, 142 aa, Staphylococcus aureus
  subsp. aureus 21195
DSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 33995 - protein, 321 aa, Staphylococcus aureus; identical to SEQ ID NO: 31900
  subsp. aureus 21195

SEQ ID NO: 33996 - protein, 315 aa, Staphylococcus aureus; identical to SEQ ID NO: 31191
  subsp. aureus 21195

SEQ ID NO: 33997 - protein, 325 aa, Staphylococcus aureus; identical to SEQ ID NO: 30479
  subsp. aureus 21195

SEQ ID NO: 33998 - protein, 886 aa, Staphylococcus aureus
  subsp. aureus 21195
MIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 33999 - protein, 1019 aa, Staphylococcus aureus
  subsp. aureus 21195
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNHSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 34000 - protein, 233 aa, Staphylococcus aureus; identical to SEQ ID NO: 31039
  subsp. aureus 21195

SEQ ID NO: 34001 - protein, 674 aa, Staphylococcus aureus
  subsp. aureus 21195
MSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPSPEPDPDSDSDSDSGSDSDSGSDSDSDSDSDSDSDSDSNSDSESDSDSDSDSDSDSDSDSDSDSDSDSDSDSDSESDSDSDSDSDSDSDSDSDSDSDSDSDSDSDSDSDSESDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 34002 - protein, 68 aa, Staphylococcus aureus
  subsp. aureus 21195
MKKRIDYLSNKQNKYSIRRFTVGTTSVIVGATILFGIGNHQAQASEQSNDTTQSSKNNASADSEKTIR

SEQ ID NO: 34003 - protein, 2219 aa, Staphylococcus aureus
  subsp. aureus 21195
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSSSTSISTSISGSASTSTSLSDSTSLSTSLSDSASGSKSNSLSASMSTSDSISTRKSESLSTSTSLSGSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSGSESESDSQSISTSASDSTSESTSTSLSDSTSTSNSTSESTSKAISTSASASESDSSSTSLSDSTSASMQSSESDSQSTSASLSNSQSTSTSNRMSTITSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSSSLNGSESVSESSSLSDSISMSDSTSTSDSDSLSGSISLSGSTSLSTSDSLSDSKSLSSSQSMSGSESTSTSVSDSQSSSTSNSQFDSMSISASESDSVSTSDSSSISRSNSTSTSLSTSDSMSGSVSVSTSTSLSDSISGSTSVSDSSSTSTSESLSDSMAQSQSTSTSASGSLSTSISTSMSMSASKSTSQSTSVSTSLSTSDSISDSTSISISGSQSAVESESTSDSTSISDSESLSTSDSDSTSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 34004 - protein, 681 aa, Staphylococcus aureus; identical to SEQ ID NO: 31046
  subsp. aureus 21195

SEQ ID NO: 34005 - protein, 1183 aa, Staphylococcus aureus; identical to SEQ ID NO: 31200
  subsp. aureus 21195

SEQ ID NO: 34006 - protein, 105 aa, Staphylococcus aureus; identical to SEQ ID NO: 31168
  subsp. aureus 21195

SEQ ID NO: 34007 - protein, 354 aa, Staphylococcus aureus; identical to SEQ ID NO: 30412
  subsp. aureus 21195

SEQ ID NO: 34008 - protein, 648 aa, Staphylococcus aureus; identical to SEQ ID NO: 31909
  subsp. aureus 21195

SEQ ID NO: 34009 - protein, 325 aa, Staphylococcus aureus; identical to SEQ ID NO: 30484
  subsp. aureus 21195

SEQ ID NO: 34010 - protein, 312 aa, Staphylococcus aureus; identical to SEQ ID NO: 30391
  subsp. aureus 21195

SEQ ID NO: 34011 - protein, 783 aa, Staphylococcus aureus
  subsp. aureus 21195
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSDSDSDSESDSDSDSDSDSDSDSDSDSDSDSDSDSDSDSDSESDSDSDSDS

SEQ ID NO: 34012 - protein, 890 aa, Staphylococcus aureus
  subsp. aureus 21195
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMSQPAQPKASANSDQASSQPAHETNSNDNTNDATNASSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTIEPLNVQTGQEDKVTATDTAENSSTATNPKDASDKADVIELESDVVKDADSSVDKDVQNDVDHLSDMSDNTHLDKYDFKEMDTQIAKDTDKGVDNSLGMTSNVDTDKDSNKNEGKVIQLAHNTDKNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 34013 - protein, 108 aa, Staphylococcus aureus
  subsp. aureus 21195
SDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 34014 - protein, 109 aa, Staphylococcus aureus; identical to SEQ ID NO: 33345
  subsp. aureus 21196

SEQ ID NO: 34015 - protein, 644 aa, Staphylococcus aureus
  subsp. aureus 21196
MNKQQKEFKSFYSIRKSSLGVASVAISTLLLLMSNGEAQAAEETGGTNTEAQPKTEAVASPTTTSEKAPETKPVANAVSVSNKEVEAPTSETKEAKEVKEVKAPKETKAVKPATKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 34016 - protein, 350 aa, Staphylococcus aureus
  subsp. aureus 21196
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYSDNKSFREG

SEQ ID NO: 34017 - protein, 945 aa, Staphylococcus aureus
  subsp. aureus 21196
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSASDSDSDSDSDSSSDSDSESDSNSDSESGSNNNVVPPNSPKNGTNASNKNEAKDSKEPLPDTGSEDEANSSLIWGLLASLGSLLLFRRKKENKDKK

SEQ ID NO: 34018 - protein, 241 aa, Staphylococcus aureus; identical to SEQ ID NO: 32458
  subsp. aureus 21196

SEQ ID NO: 34019 - protein, 983 aa, Staphylococcus aureus
  subsp. aureus 21196
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSD

SEQ ID NO: 34020 - protein, 231 aa, Staphylococcus aureus; identical to SEQ ID NO: 33623
  subsp. aureus 21196

SEQ ID NO: 34021 - protein, 275 aa, Staphylococcus aureus
  subsp. aureus 21196
KPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDAGKHTPAKPMSTVKDQHKTAKALPETGSENNNSNNGTLFGGLFAALGSLLLFGRRKKQNK

SEQ ID NO: 34022 - protein, 702 aa, Staphylococcus aureus
  subsp. aureus 21196
MTRTYRNIEKIAEAMKHKDTKLNTPDNKNKVKDALEWLHKNAYGKEPVKKLEELKTNFSKSAPQKNTNLNWWDYEIGTPRALTNTLILLKEDFTDEEKKKYTAPIKTFAPKSDEILSSVGKAEPAKGGNLVDISKVKLLESIIEEDATMMKESIEAFNKVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSTSATVMKSLLRLSDAMDESTKAKYKQIVKTSVKSDSSYKQNDYLSSYSDISKMKSLIEDSTISTNGLTQQLKIYNDMNRVTYHNKDLDFAFGLSMTSKNVAHYESINGENLKGWHTGAGMSYLYNSDVKHYRDNFWATADMKRLAGTTTLDNEEPKENKNSDKTFVGGTKFDDQHASIGMDFENQDKTLTAKKSYFILNDKIVFLGTGIKSTDSSKNPVTTIENRKSNGYTLFTDDKQTTASNINDQETNSVFLESTDTKKNIGYHFLNESKITVKKESHTGKWSDINKSQKSDDKTDEYYEVTQKHSNTDDKYAYVLYPGLSKDNFKSKASQVTIVKQDDDFHIVKDNESVWAGVNYSNSTQTFDINNTKVEVKAKGMFILKNKDDNTYECSFYNPESTNTASDIESKISMTGYSITNKNTSTSNESGVRFELQQTLNKDDN

SEQ ID NO: 34023 - protein, 138 aa, Staphylococcus aureus
  subsp. aureus 21196
MGEFEVKYLTGFILILLLEGIFTNSASAIEYSDLHHKSKLNSKRLYNAKVSFANPTDLENKNTNDRLLKHDLLFHDMFVNVASKKDFKVEFENEALSKKFINKNIDIYAGSYSYECHGGATNKTQCSYGGVTLSDNNK

SEQ ID NO: 34024 - protein, 291 aa, Staphylococcus aureus; identical to SEQ ID NO: 30390
  subsp. aureus 21196

SEQ ID NO: 34025 - protein, 434 aa, Staphylococcus aureus [sequence omitted]

SEQ ID NO: 34026 - protein, 319 aa, Staphylococcus aureus; identical to SEQ ID NO: 30495
  subsp. aureus 21196

SEQ ID NO: 34027 - protein, 338 aa, Staphylococcus aureus; identical to SEQ ID NO: 31292
  subsp. aureus 21196

SEQ ID NO: 34028 - protein, 165 aa, Staphylococcus aureus; identical to SEQ ID NO: 30418
  subsp. aureus 21196

SEQ ID NO: 34029 - protein, 241 aa, Staphylococcus aureus; identical to SEQ ID NO: 30739
  subsp. aureus 21196

SEQ ID NO: 34030 - protein, 241 aa, Staphylococcus aureus; identical to SEQ ID NO: 30738
  subsp. aureus 21196

SEQ ID NO: 34031 - protein, 96 aa, Staphylococcus aureus; identical to SEQ ID NO: 31559
  subsp. aureus 21196

SEQ ID NO: 34032 - protein, 350 aa, Staphylococcus aureus; identical to SEQ ID NO: 33885
  subsp. aureus 21196

SEQ ID NO: 34033 - protein, 269 aa, Staphylococcus aureus
  subsp. aureus 21196
GQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34034 - protein, 321 aa, Staphylococcus aureus
  subsp. aureus 21196
KPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34035 - protein, 62 aa, Staphylococcus aureus; identical to SEQ ID NO: 30610
  subsp. aureus 21196

SEQ ID NO: 34036 - protein, 1077 aa, Staphylococcus aureus
  subsp. aureus 21196
MLNRENKTAITRKGMVSNRLNKFSIRKYTVGTASILVGTTLIFGLGNQEAKAAESTNKELNEATTSASDNQSSGKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKDGKQDSTEKGISGVTVTLKDENGNVLKTVTTDADGKYKFTDLDNGNYKVVFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIF

SEQ ID NO: 34037 - protein, 238 aa, Staphylococcus aureus; identical to SEQ ID NO: 30740
  subsp. aureus 21196

SEQ ID NO: 34038 - protein, 233 aa, Staphylococcus aureus
  subsp. aureus 21196
MKLKNIAKASLALGILTTGMITTTAQPVKASEYSDLRAVSNDTFNLKTYYTGPNFNYKNLKGYKEGNKVEFVDEITHQLNVIDLKGSDKEKLKDMIDGTLFDVFVVREGTTKDATNYSIGGISKPNSKSYIDTLKNVNLKVSKKVSSNSATVASSHFEINKEEISLKELDFKLRKQLIDNHDLYKTEPKDSKITVTMNNGDYYTFELNKKLQEHRMGDVIDGTKIKEINVELN

SEQ ID NO: 34039 - protein, 233 aa, Staphylococcus aureus; identical to SEQ ID NO: 30428
  subsp. aureus 21196

SEQ ID NO: 34040 - protein, 931 aa, Staphylococcus aureus
  subsp. aureus 21196
MIVVGMGQEKEAAASEQNNTTVEESGSSATESKASETQTTTNNVNTIDETQSYSVTSTEQPSQSTQVTTEEAPTTVQAPKVETSRVDLPSEKVADKETTGTQVDTAQPSNFSEIKPRVKRSADVAVVAGEAKATGTDVTNKVTVENGSEIVGHKQDTNVVNPHNAERVTLKYKWKFGEGIKEGDYFDFTLSDNVETHGISTLRKVPEIKSTDGQVMAIGEVVEERKIRYTFKEYVKDKKDLTAELSLNLFIDPTTVTKQGKQKVEVTLGDKTIEKEFDIKYLDGVKDRMGVTVNGRIDTLNKEDGKFSHFAYIKPNNRSLSSVTVTGQVTSGHKQNANNPTVKVYKHIGSDELAESVYAKLDDASKFEDVTEKVNLSYTGEGGYSFTFDSLEDNNNYVVKYEGEYNTKAKDLNFQTRLTGYHNYYPYYPYYPVQLTWNNGVAFYSNNAQGDGKDKPKEPIIEHSTPIELEFKSEPPVEKHELTGTIEESNDSKPIDFEYHTAVEGAEGHAEGIIETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENYQHISHSGLGTENGHGNYGVIEEIEENSHVDIKSELGYEGGQNSGNQSFEEDTEEDKPKYEQGGNIVDIDFDSVPQIQGQNNGDQSFEEDTEEDKPKYEQGGNIIDIDFDSVPHIHGFNKHTEIIEEDTNKDKPNYQFGGHSSVDFEEDTLPQVSGHNEGQQTIEEDTTPPIVPPTPPTPEVPSEPETPTPPTPEVPSEPETPTPPTPEVPSEPEVPTPPTPEIPSEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 34041 - protein, 525 aa, Staphylococcus aureus
  subsp. aureus 21196
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGK

SEQ ID NO: 34042 - protein, 331 aa, Staphylococcus aureus
  subsp. aureus 21196
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSANNDSEENEQSSKDEDKQNTSKSDKSSVEKSESNEETAPVEPMPHSKPTTSEAPPSQNIHNEDSMYDASTE

SEQ ID NO: 34043 - protein, 694 aa, Staphylococcus aureus
  subsp. aureus 21196
MTRTYRNIEKIAEAMKHKDTKLKTDENKKKVKDALDWLHENAYGKEPDKKVKELTENFKITDSSKKKALNWWDYEIGTPRALTNTLILLNGDISSDEKKKYTAPIKTFAPDSDKILSSVGKPEQAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMISLLRLSDAMDESTKAKYKQIVKTSVKSDSSYKQNDYLSSYSDISKMKSLIEDSTISTNGLTQQLKIYNDMDRVTYHNKELDFAFGLSMTSKNVARYESINGENLKGWHTGAGMSYLYNSDVKHYRDNFWATADMTRLPGTTTLNDMPSTNTKNDNSFVGGTKFDEQHASIGMDYENQDKTLTAKKSYFILNDKIVFLGTGIKSTGSSENPITTIENRKANEYKLYKDDIENTTSNDNTQETHSVFLESSDTKKNIGYHFLDKPKISVKKETHIGKWKDINNSQSNTQKNDDYYEVTQTHNTSDSKYAYVLYPGLTKSDFKSKNNIVNNIKQDEDFHVIKDNDGIFAGVNYSDSTKTFDINGTKVEVKAKGMFVIKKKDDKTYECSFYNPETTNTASNIESKISIAGYTLINKSVTNSNEAGVNFELTK

SEQ ID NO: 34044 - protein, 311 aa, Staphylococcus aureus; identical to SEQ ID NO: 30617
  subsp. aureus 21196

SEQ ID NO: 34045 - protein, 1006 aa, Staphylococcus aureus
  subsp. aureus 21196
MIVVGMGQDKEAAASEQKTTTVEENGNSATDNKVNETQTTTTNVNTIDETQSYSATATEQPSNATQVTTEKAPKAVQAPQTAQPANVETVKEEVVKEEANPQVKETTQSQDNSGDQRQVDLTPKKATQNQAAETQVEVAQPRTVSESKPRVTRSADVAEAKEASDAKVETGTDVTSKVTVESGSIEAPQGNKVEPHAGQRVVLKYKLKFEKGLHKGDYFDFTLSNNVNTYGVSTARKVPEIKNGSVVMATGQLLGNGKIRYTFTDYIDYKVNVTADLEINLFIDPKTVQSNGQQTITSTLNDKETKNTLPIEYNPGVSNSYANVNGSIETFDKGNNKFTHVAYIKPQNGHKSDSVSITGTLTQGSKANGNVPTVKVYEVLKDAKELPESVYANISDSTMFKDVTQEMKDKLKVENNGSYKLDIEKLEKSYVIHYDGEYLSGSDQVNFRTHMFGYPEQQYKYYYTHLGYQLTWDNGLVLYSNKAKGDGTNGTITESNNMTFDEEYGTGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEQGGNIIDIDFDSVPQIHGFNKHNEIIEEDTNKDKPNYQFGGHNIVDFEEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 34046 - protein, 2275 aa, Staphylococcus aureus
  subsp. aureus 21196
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSTSTSASLSGSESESDSQSISTSASESTSESTSTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSESLSDSMAQSQSTSTSASGSLSTSISTSMSMSASTSTSQSTSVSTSLSTSDSISDSTSISISGSQSTVESESTSDSTSISDSESLSTSDSDSTSTSTSDSTSSSTSTSISESLSTSGSGSTSVSDSTSMSESDSTSVSMSQSMSGSTHNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 34047 - protein, 232 aa, Staphylococcus aureus
  subsp. aureus 21196
MKFTAIAKAIFVLGILTTSAMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGAADKGRIVINMKDENKYEIDLSDKLDFERMADVISSEQIKNIEVNLK

SEQ ID NO: 34048 - protein, 203 aa, Staphylococcus aureus; identical to SEQ ID NO: 30347
  subsp. aureus 21196

SEQ ID NO: 34049 - protein, 2473 aa, Staphylococcus aureus
  subsp. aureus 21196
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAPVAANAQTQDPNASNTGEGSINTTLTFDDPAISTDENRQDPTVTVTDKVNGYTLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKSDQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADTEVENAYNTRKQEIQNSNASTTEEKEAAYTELDAKKQEARTNLDAANTNSAVTTAKDNSIAAINQVQAATTKKSDAKAEIAQKASERKTAIEAMNASTTEEQQAAKEKVDQAVLSANADIDNAAANTDVDNVKTTNEATIAAITPDANVKPTAKQAIADKVQAQETAIDANNGATTEEKAAAKQQVQTEKTTADTAIDGAHSNAEVEAAKNAEIAKIEAIQPATTTKDDAKQAIATKANERKTAIAQTQDITAEEIAAANVNVDNAVTEANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKKAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDYIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGRDSTNQSMVESTTETLPSADITEPNVPSNTSKDKEESTTNQTDAGQLKSETNVASNEADKSPSKAVTEVSNKPSTSASSEAKDKMTSTNVSQKDDTATADTNDTQKSVGSAANNKATQNDGANASPATVSNGSNSANQDMLNVTKPEENKAKAKSAQQGKVNKPKQQAKTLPDTGMSHNDDLPYAELALGAGMAFLIRRFTKKDQQTEE

SEQ ID NO: 34050 - protein, 241 aa, Staphylococcus aureus; identical to SEQ ID NO: 33853
  subsp. aureus 21196

SEQ ID NO: 34051 - protein, 315 aa, Staphylococcus aureus; identical to SEQ ID NO: 30440
  subsp. aureus 21196

SEQ ID NO: 34052 - protein, 325 aa, Staphylococcus aureus; identical to SEQ ID NO: 30407
  subsp. aureus 21196

SEQ ID NO: 34053 - protein, 985 aa, Staphylococcus aureus
  subsp. aureus 21196
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPKPTPDPEPSPDPDPDPDSDSDSDSGSDSDSGSDSDSDSDSDSDSDSDSDSDSDSDSDSDSDSDSDSDSDSNSDSDSDSESDSDSESDSDSESDSDSDSDSDSESDSDSDSDSESDSDSDSDSDSDSDSDSDSDSDSDSESDSDSDSDSESDSDSDSESDSDSDSDSESDSDSDSDSDSDSDSDSDSDSDSDSDSDSDSESDSDSESDSDSDSDSDSESDSESDSDSDSESDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 34054 - protein, 895 aa, Staphylococcus aureus
  subsp. aureus 21196
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDKNDAVVTNDQSSSDASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDSKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDEVKVTDNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 34055 - protein, 321 aa, Staphylococcus aureus; identical to SEQ ID NO: 30959
  subsp. aureus 21196

SEQ ID NO: 34056 - protein, 211 aa, Staphylococcus aureus
  subsp. aureus 21196
MKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLMDGTKDPNVINQLKNANGTSNNSAVNPSIKANDIHTKSNKQMAKQQSIHLDSKSKSVHKQQLKELPKTGVNNESNTAIMVLFIGLILLVVSLVTRFIKLNSHQ

SEQ ID NO: 34057 - protein, 226 aa, Staphylococcus aureus
  subsp. aureus 21196
MKFKAIAKASLALGMLATGVITSNIQSVQAKTEVKQQSESELKHYYNKPFFERKNVTGYKYTENGKDYMEVATDHQYYQISLLGPDKDKFKEGNNPGLDIFVVREGDSRQAANYSIGGVTKTNSQPFIDYIHTPILEIKKGKEEPQSSLYQIYKEDISLKELDYRLRERAIKQHGLYSNGLKQGRITITMKDGKSHTIDLSQKLEKERMGDSIDGRQIQKILVEIK

SEQ ID NO: 34058 - protein, 234 aa, Staphylococcus aureus; identical to SEQ ID NO: 33390
  subsp. aureus 21196

SEQ ID NO: 34059 - protein, 232 aa, Staphylococcus aureus
  subsp. aureus 21196
MKLTTIAKATLALGILTTGVFTAESQTGHAKVELDETQRKYYINMLHQYYSEESFEPTNISVKSEDYYGSNVLNFKQRNKAFKVFLLGDDKDKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKKIKNIEVNLN

SEQ ID NO: 34060 - protein, 47 aa, Staphylococcus aureus
  subsp. aureus 21196
NYKNEKLLPNTGMKQEGKNTAFSSIIIILMASMLFINKRRKKENKEI

SEQ ID NO: 34061 - protein, 327 aa, Staphylococcus aureus
  subsp. aureus 21196
MKMKKLIKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 34062 - protein, 123 aa, Staphylococcus aureus
  subsp. aureus 21196
DSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34063 - protein, 231 aa, Staphylococcus aureus
  subsp. aureus 21196
MKLKTLAKATLALGLLTTGVITSEGQAVQAKEKQERVQHLYDIKDLHRYYSSESFEFSNISGKVENYNGSNVVRFNQEKQNHQLFLLGKDKEEYKEGIEGKDVFVVKELIDPNGRLSTVGGVTKKNNQSSETNIHLLVNKLDGGNLDATNDSFLINKEEVSLKELDFKIRKQLVEKYGLYQGTSKYGKITIILNGGKKEVIDLGDKLQFERMGDVLNSKDINKIEVTLKQI

SEQ ID NO: 34064 - protein, 2186 aa, Staphylococcus aureus
  subsp. aureus 21196
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSADAKNYQAQGNVIALGRIKGNDTNDHGDFNGIEKTLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYQVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATDDEKNAAINTLNQDRQQAIESVKQANTNAEVDQAATVAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKVNELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLSKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEPTKVSPKVIQPAPKVCTPIKKEETHESRKVEKELPNTGSEGMDLPLKEFALITGAALLARRRTKNEKES

SEQ ID NO: 34065 - protein, 231 aa, Staphylococcus aureus; identical to SEQ ID NO: 30578
  subsp. aureus 21196

SEQ ID NO: 34066 - protein, 666 aa, Staphylococcus aureus
  subsp. aureus 21196
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNRKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIF

SEQ ID NO: 34067 - protein, 500 aa, Staphylococcus aureus
  subsp. aureus 21196
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNNKPGKEDGNKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34068 - protein, 252 aa, Staphylococcus aureus
  subsp. aureus 21196
MENKNNRYSIRKFSVGVGSILIASFIMIFQNEAHASEKAIETPKEEKAIETPKEEKAIETPKEEKAIETPKEEKAIETPKNSNDLKFLKDAKFSSDSENLDIRLRPEYNVGNALVVRVDKEINPEKFVDYPEGYTVQSYVSKGSDYPSVEKIVKNKITGMYKITYTLMDKAGNPVNGSDGQVVIRSLNIYFYDPTPVLESIDKVNKKIKDGNYSNGDEVKKELDKIRVDIERPKEIPNIKEFLSKVDMEEKK

SEQ ID NO: 34069 - protein, 681 aa, Staphylococcus aureus
  subsp. aureus 21196
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVTSQQQSKEADNSQDSNANNNLPSQSLTKEAPSLNKSDQTSQREIVNETEIEKVQPQQNNQANDKITNYNFKNEQEVKPQKDEKTLSVSDLKNNQKSPVEPTKENDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34070 - protein, 227 aa, Staphylococcus aureus; identical to SEQ ID NO: 33376
  subsp. aureus 21196

SEQ ID NO: 34071 - protein, 691 aa, Staphylococcus aureus
  subsp. aureus 21196
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNVTNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKIRPIKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 34072 - protein, 343 aa, Staphylococcus aureus
  subsp. aureus 21196
MKITTIAKTSLALGLLTTGVITTTTQAANATTPSSTKVEAPQQTANATTPPSTKVETTQAANATTPSSTKVETPQQTPNPPTSPSTKVETPQQAANATTPSSTKVEVPQSTPLSTKVEAPQSKPNATTPPSSNVDTSPPQSPTTKQVPTEINPKFKDLRAYYTKPSIEFKNEIGIILKKWTTIRFMNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 34073 - protein, 356 aa, Staphylococcus aureus
  subsp. aureus 21196
MKMRTIAKTSLALGLLTTGAITVTTQSVKAEKVQSTKVDKISTLKAERLAMINITAGANTVTTQAAKTGQERTPKLEKAPNTNEEKTSTSKIEKVSQPKQEAQKLLNISATPAPKQEQSQTTTESTTPKTRVTTPPSTNTPQPMQSTKSDTPQSPNIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSITKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 34074 - protein, 233 aa, Staphylococcus aureus; identical to SEQ ID NO: 32856
  subsp. aureus 21200

SEQ ID NO: 34075 - protein, 1153 aa, Staphylococcus aureus
  subsp. aureus 21200
MINRDNKKAITKKGMISNRLNKFSIRKYTVGTASILVGTTLIFGLGNQEAKAAENTSTENAKQDDATTSDNKEVVSETENNSTTENNLTNPIKKETNTDSQQEAKEAPTTSSTQQQQNNATTSTETRPQNIEKENVQPSTDKTATEDTSVILEEKKAPNNTNNDVTTKPSTSEIQTTPTTPQESTKIENSQPQATPSKVDNQVTDATNPKESVNVSKEELKNNPEKLKELVRNDSNTDRSTKPVAIAPTSVTPKRVNAKMRFAVAQPAAVASNNVNDLIKVTKQTIKVGDDEDNVVSAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDTTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSESDSDSDTGKHTPVKPMSTTKDHHNKAKALPETGSENNGSNNATLFGGLFAALGSLLLFGRRKKQNK

SEQ ID NO: 34076 - protein, 148 aa, Staphylococcus aureus
  subsp. aureus 21200
SDSDSDSDSDSDSDSDSDSDSDSDSGSDSDSDSDSDSDSDSDSDSDSDSDSDSDSDSDSDSDSDSDSDSDSDSDSDSDSDSDSDSDSDAGKHTPVKPMSATKDHHKKAKALPETGSENNGSNNATLFGGLFAALGSLLLFGRRKKQNK

SEQ ID NO: 34077 - protein, 250 aa, Staphylococcus aureus; identical to SEQ ID NO: 32837
  subsp. aureus 21200

SEQ ID NO: 34078 - protein, 291 aa, Staphylococcus aureus; identical to SEQ ID NO: 30390
  subsp. aureus 21200

SEQ ID NO: 34079 - protein, 891 aa, Staphylococcus aureus; identical to SEQ ID NO: 32839
  subsp. aureus 21200

SEQ ID NO: 34080 - protein, 2185 aa, Staphylococcus aureus; identical to SEQ ID NO: 32840
  subsp. aureus 21200

SEQ ID NO: 34081 - protein, 788 aa, Staphylococcus aureus
  subsp. aureus 21200
MNNKKTAINRKGMIPNRLNKFSIRKYSVGTASILVGTTLIFGLSGHEAKAAEHTNGELNQSKNETTDSSENKTTEKVDSRQQNNIEQSTTSNQPKVNESDNTSVKETTEEPQNTTSTQPTKQNNDATANKDNLEAQNISTQAKDVSATPKTTTIKRRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDADNWTLDSGFYKTPKYSLGDYVWYDSNKDGKQDSTEKGIKGVKVTLQNEKGEVIGTTETDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSD

SEQ ID NO: 34082 - protein, 689 aa, Staphylococcus aureus; identical to SEQ ID NO: 32816
  subsp. aureus 21200

SEQ ID NO: 34083 - protein, 279 aa, Staphylococcus aureus
  subsp. aureus 21200
MLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34084 - protein, 339 aa, Staphylococcus aureus; identical to SEQ ID NO: 32812
  subsp. aureus 21200

SEQ ID NO: 34085 - protein, 351 aa, Staphylococcus aureus; identical to SEQ ID NO: 32811
  subsp. aureus 21200

SEQ ID NO: 34086 - protein, 691 aa, Staphylococcus aureus; identical to SEQ ID NO: 32852
  subsp. aureus 21200

SEQ ID NO: 34087 - protein, 231 aa, Staphylococcus aureus; identical to SEQ ID NO: 32843
  subsp. aureus 21200

SEQ ID NO: 34088 - protein, 227 aa, Staphylococcus aureus; identical to SEQ ID NO: 32844
  subsp. aureus 21200

SEQ ID NO: 34089 - protein, 232 aa, Staphylococcus aureus; identical to SEQ ID NO: 33937
  subsp. aureus 21200

SEQ ID NO: 34090 - protein, 231 aa, Staphylococcus aureus; identical to SEQ ID NO: 33938
  subsp. aureus 21200

SEQ ID NO: 34091 - protein, 234 aa, Staphylococcus aureus; identical to SEQ ID NO: 32846
  subsp. aureus 21200

SEQ ID NO: 34092 - protein, 282 aa, Staphylococcus aureus; identical to SEQ ID NO: 32847
  subsp. aureus 21200

SEQ ID NO: 34093 - protein, 343 aa, Staphylococcus aureus; identical to SEQ ID NO: 32848
  subsp. aureus 21200

SEQ ID NO: 34094 - protein, 233 aa, Staphylococcus aureus; identical to SEQ ID NO: 32849
  subsp. aureus 21200

SEQ ID NO: 34095 - protein, 226 aa, Staphylococcus aureus; identical to SEQ ID NO: 32850
  subsp. aureus 21200

SEQ ID NO: 34096 - protein, 55 aa, Staphylococcus aureus; identical to SEQ ID NO: 33933
  subsp. aureus 21200

SEQ ID NO: 34097 - protein, 331 aa, Staphylococcus aureus; identical to SEQ ID NO: 32807
  subsp. aureus 21200

SEQ ID NO: 34098 - protein, 1162 aa, Staphylococcus aureus
  subsp. aureus 21200
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPLGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSD

SEQ ID NO: 34099 - protein, 98 aa, Staphylococcus aureus
  subsp. aureus 21200
SDSDSDSDSDSDSDSDSDSDSDSDSDSDSDSDSDSDSNAGKHTPAKPMSAVKDHNNKAKALPETGTENNNSNNGTLFGGLFAALGSLLLFGRRKKQNK

SEQ ID NO: 34100 - protein, 806 aa, Staphylococcus aureus
  subsp. aureus 21200
MTYRMKKWQKLSTITLLMAGVITLSDGEFRSVDKHQIAVADTNTQTPNYEKLKNTWLDVNYGYDKYDESNPDMKKKFEATENEAKKLLSEMKTESGRTYLWESSKDIDTKSADMTRTYRNIEKIAEAMNHPKTTLKNDENKKKLKDALEWLHKNAYGKDPDKKVADLKTNFSKSAPQKNTNLNWWDYEIGTPKSLTNTLILLNGDISSDEKKKYTAPIKTFAPKSDEILSSVGKAEPAKGGNLVDIAKVKLLESIIEEDKDMTKNSIDSFNKVFTYVQSNSTGKERNGFYKDGSYIDHQDVPYTGAYGVVLLEGISQMMPMIKETPFKETSQNDTILKSWIDDGFMPLIYKGEMMDLSRGRAISRENETSHSASVTVMKSLLRLSDAMDESTKAKYKKIVKTSVKSDSSYKQNDYLSSYSDISKMKALMEDSTLSTNDLTQQLKIYNDMDRVTYHNKDLDFAFGLSMTSKNVARYESINNENLKGWHTGAGMSYLYNSDVKHYRDNFWATADMKRLAGTTTLDNEEPKENKNSDKTFVGGTKFDDQHASIGMEFENQDKTLTAKKSYFILNDKIVFLGTGIKNTDSSMNPVTTIENRKANGYTLYTDDKQTTNSDNQETNSVFLESTDTKKNIGYHFLNKSKINVKKESHTGKWSEINKSQKTEDKKDEYYEVTQKHSNSDNKYGYVLYPSLSKDVFKSKASQVTVVKQDDDFHVVKDNESVWAGVNYSDSAKTFEINGTKVEVKAKGMFILKKKDDKTYECSFYNPESTNTASDIESKISMTGYSITNKNASTTNESGVRFELTK

SEQ ID NO: 34101 - protein, 141 aa, Staphylococcus aureus; identical to SEQ ID NO: 32806
  subsp. aureus 21200

SEQ ID NO: 34102 - protein, 696 aa, Staphylococcus aureus
  subsp. aureus 21200
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPEPSPDPDPDSDSDSDSDSGSDSDSDSESDSDSDSDSGSDSDSDSESDSDSDSDSDSDSDSDSDSDSDSDSDSDSDSDSDSDSDSDS

SEQ ID NO: 34103 - protein, 2273 aa, Staphylococcus aureus
  subsp. aureus 21200
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTFSKNTTSSSDTKSVASTSSTEQPINTSTNQSTASNNTSQSTTPSSANLNKTSTTSTSTAPVKIRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSEIVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 34104 - protein, 681 aa, Staphylococcus aureus; identical to SEQ ID NO: 32855
  subsp. aureus 21200

SEQ ID NO: 34105 - protein, 809 aa, Staphylococcus aureus; identical to SEQ ID NO: 33898
  subsp. aureus 21200

SEQ ID NO: 34106 - protein, 476 aa, Staphylococcus aureus
  subsp. aureus 21200
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDNNKPGKEDGNKPGKEDNKKPGKEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 34107 - protein, 241 aa, Staphylococcus aureus; identical to SEQ ID NO: 32842
  subsp. aureus 21200

SEQ ID NO: 34108 - protein, 258 aa, Staphylococcus aureus; identical to SEQ ID NO: 30410
  subsp. aureus 21200

SEQ ID NO: 34109 - protein, 251 aa, Staphylococcus aureus; identical to SEQ ID NO: 30946
  subsp. aureus 21200

SEQ ID NO: 34110 - protein, 256 aa, Staphylococcus aureus; identical to SEQ ID NO: 30153
  subsp. aureus 21200

SEQ ID NO: 34111 - protein, 242 aa, Staphylococcus aureus; identical to SEQ ID NO: 32821
  subsp. aureus 21200

SEQ ID NO: 34112 - protein, 239 aa, Staphylococcus aureus; identical to SEQ ID NO: 32822
  subsp. aureus 21200

SEQ ID NO: 34113 - protein, 254 aa, Staphylococcus aureus; identical to SEQ ID NO: 30809
  subsp. aureus 21200

SEQ ID NO: 34114 - protein, 321 aa, Staphylococcus aureus; identical to SEQ ID NO: 31900
  subsp. aureus 21200

SEQ ID NO: 34115 - protein, 315 aa, Staphylococcus aureus; identical to SEQ ID NO: 30183
  subsp. aureus 21200

SEQ ID NO: 34116 - protein, 325 aa, Staphylococcus aureus; identical to SEQ ID NO: 32859
  subsp. aureus 21200

SEQ ID NO: 34117 - protein, 950 aa, Staphylococcus aureus
  subsp. aureus 21200
MIVVGMGQEKEAAASEQNNTTVEESGSSATESKASETQTTTNNVNTIDETQSYSATSTEQPSQSTQVTTEEAPITVQAPKVETEMKPQEDLPSEKVVEKETAGTQVDTTQPSNVSEIKPRMKRSADVAEVAEKEVVEKEVKATGTDVTSKVTVEEGSEIVGHNNKETNVVNPHNAERVTLKYKWKFGEDVKPGDYFDFTLSNNVETHGISTLRKVPEIKSTDGQVMAVGEVNEERKIRYTFKEYVQGKKDLKAELDLNLFIDPTTVTKRGNQNIEVTLGEKKISKQFDIKYLDGVKDRMGVTVNGRIDTLNKEGGKFSHFAYVKPNNQSLTSVTVTGQVTSGYKQNANKPTVKIYKHIGSDELAESVYAKLDDANKFEDVTNKVNLSYTGDGGYSLDFSDLDNSKDYVIKYEGEYDQNAKDLNFRTHLSGYHKNYPYYPNYYYPVQLTWNNGVAFYSNSAQGDGKDKPNDPIIDKSEPIELDIKSEPPVEKHELNGTIEESNDSKPIDFEYHTAVEGSEGHVEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPGEPTPPTPEVPSEPETPTPPTPEVPSEPETPTPPTPEVPSEPETPTPPTPEVPAEPGKPVPPAKEEPKKPSKPVEQGKVVTPVIEINEKVKPVAPTKQKQSKKSELPETGGEESTNKGMLFGGLFSILGLALLRRNKKNHKA

SEQ ID NO: 34118 - protein, 1053 aa, Staphylococcus aureus; identical to SEQ ID NO: 32857
  subsp. aureus 21200

SEQ ID NO: 34119 - protein, 231 aa, Staphylococcus aureus; identical to SEQ ID NO: 33931
  subsp. aureus 21200

SEQ ID NO: 34120 - protein, 2459 aa, Staphylococcus aureus
  subsp. aureus 21200
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAAGTTQPAAGTTQPAGQGNQADPNNAVQAQPGNQAAPANQAGQGNNQATPNNAAPANQTQPANAPAAAQPAAPVAANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTANQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKATQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 34121 - protein, 154 aa, Staphylococcus aureus
  subsp. aureus 21200
SDSDSDSDSDSDSDSDSDSDSDSDSDSDSESDSDSDSDSDSDSDSDSESDSDSDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 34122 - protein, 259 aa, Staphylococcus aureus; identical to SEQ ID NO: 30226
  subsp. aureus 21200

SEQ ID NO: 34123 - protein, 268 aa, Staphylococcus aureus; identical to SEQ ID NO: 30398
  subsp. aureus 21200

SEQ ID NO: 34124 - protein, 258 aa, Staphylococcus aureus; identical to SEQ ID NO: 30237
  subsp. aureus 21200

SEQ ID NO: 34125 - protein, 372 aa, Staphylococcus aureus
  subsp. aureus 21200
MNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 34126 - protein, 241 aa, Staphylococcus aureus; identical to SEQ ID NO: 32827
  subsp. aureus 21200

SEQ ID NO: 34127 - protein, 241 aa, Staphylococcus aureus; identical to SEQ ID NO: 32828
  subsp. aureus 21200

SEQ ID NO: 34128 - protein, 238 aa, Staphylococcus aureus; identical to SEQ ID NO: 32829
  subsp. aureus 21200

SEQ ID NO: 34129 - protein, 319 aa, Staphylococcus aureus; identical to SEQ ID NO: 33918
  subsp. aureus 21200

SEQ ID NO: 34130 - protein, 165 aa, Staphylococcus aureus; identical to SEQ ID NO: 32831
  subsp. aureus 21200

SEQ ID NO: 34131 - protein, 109 aa, Staphylococcus aureus; identical to SEQ ID NO: 30603
  subsp. aureus 21200

SEQ ID NO: 34132 - protein, 350 aa, Staphylococcus aureus; identical to SEQ ID NO: 32833
  subsp. aureus 21200

SEQ ID NO: 34133 - protein, 644 aa, Staphylococcus aureus; identical to SEQ ID NO: 32834
  subsp. aureus 21200

SEQ ID NO: 34134 - protein, 973 aa, Staphylococcus aureus
  subsp. aureus 21200
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSTSDSDSASDSDSASDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSDSDSDSDSDSDSDSDSDSDLASDSDSASDSDSASDSDSDSDSDSDSDSDSNSDSDSDSDSDSDSDSDSDSDSDSDSDSDSDSDSDSDNDSDSDSDSDSASDSDSGSDSDSSSDSDSDSDSDSASDSDSDSTSDTGSDNDSDSSSDSDSDSDSDSDSDSESGSNNNVVPPNSPKNGTNASNKNEAKDSKEPLPDTGSEDEANTSLIWGFLASLGSLLLFRRKKENKDKN

SEQ ID NO: 34135 - protein, 240 aa, Staphylococcus aureus
  subsp. aureus 21200
MKKRLLFVIVITLFIFSSNHTVLSNGDVGTGNLRNFYTKYEYVNLKNVKDKNSPESHRLEYSYKNDTLYAEFDNEYITSDLKGKNVDVFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVGSTQFHLDVEISKR

SEQ ID NO: 34136 - protein, 266 aa, Staphylococcus aureus; identical to SEQ ID NO: 30426
  subsp. aureus 21200

SEQ ID NO: 34137 - protein, 434 aa, Staphylococcus aureus [sequence omitted]

SEQ ID NO: 34138 - protein, 106 aa, Staphylococcus aureus
  subsp. aureus 21201
SDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 34139 - protein, 372 aa, Staphylococcus aureus; identical to SEQ ID NO: 30609
  subsp. aureus 21201

SEQ ID NO: 34140 - protein, 434 aa, Staphylococcus aureus [sequence omitted]

SEQ ID NO: 34141 - protein, 591 aa, Staphylococcus aureus
  subsp. aureus 21201
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGS

SEQ ID NO: 34142 - protein, 246 aa, Staphylococcus aureus
  subsp. aureus 21201
ITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 34143 - protein, 321 aa, Staphylococcus aureus; identical to SEQ ID NO: 30959
  subsp. aureus 21201

SEQ ID NO: 34144 - protein, 315 aa, Staphylococcus aureus; identical to SEQ ID NO: 30573
  subsp. aureus 21201

SEQ ID NO: 34145 - protein, 325 aa, Staphylococcus aureus; identical to SEQ ID NO: 30407
  subsp. aureus 21201

SEQ ID NO: 34146 - protein, 96 aa, Staphylococcus aureus; identical to SEQ ID NO: 30813
  subsp. aureus 21201

SEQ ID NO: 34147 - protein, 2186 aa, Staphylococcus aureus; identical to SEQ ID NO: 30516
  subsp. aureus 21201

SEQ ID NO: 34148 - protein, 331 aa, Staphylococcus aureus; identical to SEQ ID NO: 30615
  subsp. aureus 21201

SEQ ID NO: 34149 - protein, 327 aa, Staphylococcus aureus
  subsp. aureus 21201
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVHYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 34150 - protein, 311 aa, Staphylococcus aureus; identical to SEQ ID NO: 30617
  subsp. aureus 21201

SEQ ID NO: 34151 - protein, 233 aa, Staphylococcus aureus; identical to SEQ ID NO: 30591
  subsp. aureus 21201

SEQ ID NO: 34152 - protein, 211 aa, Staphylococcus aureus; identical to SEQ ID NO: 30592
  subsp. aureus 21201

SEQ ID NO: 34153 - protein, 809 aa, Staphylococcus aureus; identical to SEQ ID NO: 30632
  subsp. aureus 21201

SEQ ID NO: 34154 - protein, 141 aa, Staphylococcus aureus; identical to SEQ ID NO: 30633
  subsp. aureus 21201

SEQ ID NO: 34155 - protein, 259 aa, Staphylococcus aureus; identical to SEQ ID NO: 30226
  subsp. aureus 21201

SEQ ID NO: 34156 - protein, 268 aa, Staphylococcus aureus; identical to SEQ ID NO: 30398
  subsp. aureus 21201

SEQ ID NO: 34157 - protein, 258 aa, Staphylococcus aureus; identical to SEQ ID NO: 30228
  subsp. aureus 21201

SEQ ID NO: 34158 - protein, 254 aa, Staphylococcus aureus; identical to SEQ ID NO: 30809
  subsp. aureus 21201

SEQ ID NO: 34159 - protein, 239 aa, Staphylococcus aureus; identical to SEQ ID NO: 30622
  subsp. aureus 21201

SEQ ID NO: 34160 - protein, 242 aa, Staphylococcus aureus; identical to SEQ ID NO: 30399
  subsp. aureus 21201

SEQ ID NO: 34161 - protein, 131 aa, Staphylococcus aureus; identical to SEQ ID NO: 30867
  subsp. aureus 21201

SEQ ID NO: 34162 - protein, 165 aa, Staphylococcus aureus; identical to SEQ ID NO: 30805
  subsp. aureus 21201

SEQ ID NO: 34163 - protein, 258 aa, Staphylococcus aureus; identical to SEQ ID NO: 30410
  subsp. aureus 21201

SEQ ID NO: 34164 - protein, 241 aa, Staphylococcus aureus; identical to SEQ ID NO: 30608
  subsp. aureus 21201

SEQ ID NO: 34165 - protein, 241 aa, Staphylococcus aureus; identical to SEQ ID NO: 30607
  subsp. aureus 21201

SEQ ID NO: 34166 - protein, 238 aa, Staphylococcus aureus; identical to SEQ ID NO: 30606
  subsp. aureus 21201

SEQ ID NO: 34167 - protein, 430 aa, Staphylococcus aureus
  subsp. aureus 21201
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKV

SEQ ID NO: 34168 - protein, 938 aa, Staphylococcus aureus; identical to SEQ ID NO: 30838
  subsp. aureus 21201

SEQ ID NO: 34169 - protein, 1015 aa, Staphylococcus aureus; identical to SEQ ID NO: 30839
  subsp. aureus 21201

SEQ ID NO: 34170 - protein, 981 aa, Staphylococcus aureus
  subsp. aureus 21201
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSD

SEQ ID NO: 34171 - protein, 1367 aa, Staphylococcus aureus
  subsp. aureus 21201
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34172 - protein, 967 aa, Staphylococcus aureus
  subsp. aureus 21201
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 34173 - protein, 231 aa, Staphylococcus aureus; identical to SEQ ID NO: 30630
  subsp. aureus 21201

SEQ ID NO: 34174 - protein, 2481 aa, Staphylococcus aureus
  subsp. aureus 21201
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQAKQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKERANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 34175 - protein, 682 aa, Staphylococcus aureus
  subsp. aureus 21201
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDS

SEQ ID NO: 34176 - protein, 227 aa, Staphylococcus aureus; identical to SEQ ID NO: 30586
  subsp. aureus 21201

SEQ ID NO: 34177 - protein, 227 aa, Staphylococcus aureus; identical to SEQ ID NO: 30585
  subsp. aureus 21201

SEQ ID NO: 34178 - protein, 232 aa, Staphylococcus aureus; identical to SEQ ID NO: 30584
  subsp. aureus 21201

SEQ ID NO: 34179 - protein, 232 aa, Staphylococcus aureus; identical to SEQ ID NO: 30583
  subsp. aureus 21201

SEQ ID NO: 34180 - protein, 231 aa, Staphylococcus aureus; identical to SEQ ID NO: 30582
  subsp. aureus 21201

SEQ ID NO: 34181 - protein, 234 aa, Staphylococcus aureus; identical to SEQ ID NO: 30581
  subsp. aureus 21201

SEQ ID NO: 34182 - protein, 292 aa, Staphylococcus aureus; identical to SEQ ID NO: 30580
  subsp. aureus 21201

SEQ ID NO: 34183 - protein, 356 aa, Staphylococcus aureus; identical to SEQ ID NO: 30793
  subsp. aureus 21201

SEQ ID NO: 34184 - protein, 231 aa, Staphylococcus aureus; identical to SEQ ID NO: 30578
  subsp. aureus 21201

SEQ ID NO: 34185 - protein, 226 aa, Staphylococcus aureus; identical to SEQ ID NO: 30577
  subsp. aureus 21201

SEQ ID NO: 34186 - protein, 203 aa, Staphylococcus aureus; identical to SEQ ID NO: 30576
  subsp. aureus 21201

SEQ ID NO: 34187 - protein, 691 aa, Staphylococcus aureus; identical to SEQ ID NO: 30511
  subsp. aureus 21201

SEQ ID NO: 34188 - protein, 241 aa, Staphylococcus aureus; identical to SEQ ID NO: 30571
  subsp. aureus 21201

SEQ ID NO: 34189 - protein, 367 aa, Staphylococcus aureus
  subsp. aureus 21201
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKTW

SEQ ID NO: 34190 - protein, 61 aa, Staphylococcus aureus
  subsp. aureus 21201
MIKPGQELVVDKKQPANHADANKAQALPETGEENPFIGTTVFGGLSLALGAALLAGRRREL

SEQ ID NO: 34191 - protein, 681 aa, Staphylococcus aureus; identical to SEQ ID NO: 30598
  subsp. aureus 21201

SEQ ID NO: 34192 - protein, 2271 aa, Staphylococcus aureus; identical to SEQ ID NO: 30597
  subsp. aureus 21201

SEQ ID NO: 34193 - protein, 62 aa, Staphylococcus aureus; identical to SEQ ID NO: 30610
  subsp. aureus 21201

SEQ ID NO: 34194 - protein, 138 aa, Staphylococcus aureus; identical to SEQ ID NO: 30785
  subsp. aureus 21201

SEQ ID NO: 34195 - protein, 291 aa, Staphylococcus aureus; identical to SEQ ID NO: 30390
  subsp. aureus 21201

SEQ ID NO: 34196 - protein, 891 aa, Staphylococcus aureus; identical to SEQ ID NO: 30788
  subsp. aureus 21201

SEQ ID NO: 34197 - protein, 274 aa, Staphylococcus aureus; identical to SEQ ID NO: 30872
  subsp. aureus 21201

SEQ ID NO: 34198 - protein, 338 aa, Staphylococcus aureus; identical to SEQ ID NO: 30627
  subsp. aureus 21201

SEQ ID NO: 34199 - protein, 351 aa, Staphylococcus aureus; identical to SEQ ID NO: 30628
  subsp. aureus 21201

SEQ ID NO: 34200 - protein, 165 aa, Staphylococcus aureus; identical to SEQ ID NO: 30418
  subsp. aureus 21201

SEQ ID NO: 34201 - protein, 109 aa, Staphylococcus aureus; identical to SEQ ID NO: 30603
  subsp. aureus 21201

SEQ ID NO: 34202 - protein, 350 aa, Staphylococcus aureus; identical to SEQ ID NO: 30602
  subsp. aureus 21201

SEQ ID NO: 34203 - protein, 645 aa, Staphylococcus aureus; identical to SEQ ID NO: 30601
  subsp. aureus 21201

SEQ ID NO: 34204 - protein, 319 aa, Staphylococcus aureus; identical to SEQ ID NO: 30605
  subsp. aureus 21201

SEQ ID NO: 34205 - protein, 107 aa, Staphylococcus aureus
  subsp. aureus 21201
DSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34206 - protein, 274 aa, Staphylococcus aureus; identical to SEQ ID NO: 33993
  subsp. aureus 21202

SEQ ID NO: 34207 - protein, 338 aa, Staphylococcus aureus
  subsp. aureus 21202
MIKQVCKNITICSLALSTALTIFPASSYAKINSEIKQVSEKNLDGETKMYTRTATTSDSQKNITQSLQFNFLTEKNYDKETVFIKAKGTIGSGLRILEPNGYWNSTLRWPGSYSVSIQNVDDNNNTNVTDFAPKNQDESREVKYTYGYKTGGDFSINRGGLTGNITKESNYSETISYQQPSYRTLIDQPTTNKGVAWKVEAHLINNMGHDHTRQLTNDSDDRVKSEIFSLTRNGNLWAKDNFTPKNKMPVTVSEGFNPEFLAVMSHDKKDEGKSKFVVHYKRSMDEFKIDWNKHGFWGYWSGENHVDKKEEKLSALYEVDWKTHNVKFIKVLNDKEKK

SEQ ID NO: 34208 - protein, 351 aa, Staphylococcus aureus
  subsp. aureus 21202
MKNKKRVFIASSLSCALLLLSAANTEANSANKDSQDQTKKEHVDKAQQKEKRNVNEKDKNTPGPDDIGKNGKVTKRTETVYDEKTNILQNLQFDFIDDPTYDKNILLVKKQGSIHSNLKFESHKEENNSSWLKYPSEYHVDFQVKRNRKTEILDQLPKNKISTAKVDSTFSYNSGGKFDSVKGVGRTSSNSYSKTISYNQQNYDTIASGKNNNWHVHWSVVANDLKYGGEVKNRNDEFLFYRTTRLSTVENPELSFASKYRYPALVRSGFNPEFLTYLSNEKSNEKTQFEVTYTRNQDILKNKPGIHYAPPILEKNKDGQRLIVTYEVDWKNKTVKVIDKYSDDNKPYKEG

SEQ ID NO: 34209 - protein, 2912 aa, Staphylococcus aureus
  subsp. aureus 21202
MNYRDKIQKFSIRKYTVGTFSTVIATLVFLGLNTSHAQAAETNQLASVLKQKQQNGDAQTENRESQTQNSQNSQNGQSLSAPIENEQPNNNQTNQVDASGAQPYTTKHDQPVSQNEQAKKDTTDATPTQSAKAESKHEQNESRSANKKGNDNNATHVENHEANVVTASDSSDSGSVQHDRNELQAFFDANYHDYRFIDRENADSGTFNYVKGIFDKINTLLGSNDPINNKDLQVAYKELEQAVALIRTMPQRQQTSRRSSRIQTRSIESRSAEPRSVSSYQNADSSYYVENANDGSGYPVGTYINASNKGAPYNLPTTPWNTLKASAAKEIALITAKQTGDGYQWVIKFNKGHAPHENMIYWFALPADQVPVGRTDFVTVNADGTNVQWSNGAGAGANKPLQQMWEYGVNDPHRSHDFKIRNRSGQVIYEWPTVHINSLTDLARAGDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQTVNRTYRLGTTKRVEISHGNVQTKKVLESSNLNIDDFIDDPLSYVKTPSNKVLGFYPTSANTNAFRQGGVNPLNDYQLSQLFSDDKLQQAARTGSPIRLMIGFDYPDGHGNAETLVPVNLTVLPEIQHNIKFFKNDDGQNIADKPASKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTITTTAEQLRGTALQKVPVTVSGVPLDPSALVYLVIPTSQTRDGGSEADQIPSGYTKIATGTPDGVHSTITIRPEDYVVFIPPVGNQIRALIYYNNVVASNMSNAVTILPDDIPPTINNPVGLNAKYYRGDEVSFTMGVSDRHSGIKSTTITTLPSGWTSNLTKANKNNGSLSITGRVSMNQAFNSDITFKVSATDNVNNTTNDSQSKHVTVHVGKISDDAHPIVLGNSEKVVVVNPTALTGDEKQRIITAFMNKNQNIRGYLASSNPVAVDDHGNVTLHYRDGSSTALDATNVMTYEPVVKTEYQTANAPKTATVTIAKAQSFSIGDIKQYFTLSNGQAIPSGTFTNITSDRTIPTAQEVSQMNAGTQLYHIVASNAYHKDTEDFYISLKIIDVKQPEGDQRVYRTSTYDLTTDEISKVKQAFINANRDIITLAEGDISVTNTPNGANVSTITVNINKGRLTKSFTSNLTNMNFLRWISFPQDYTVTWTNAKIANRPTDGGLSWSDDHKSLIYRYDATLGTQITTNDILTMLKATTTVAGLRNNIAGNEKAQAEAGGRPNYKSSGYSQSNPTTDGQRQFTLNGQVIQVLDIINPSNGFGGQPVTNSNVRANHSNSTVVSVSESAANGAGAFTIDHVVKNNSTHNAADAVYKAQLYLSPYGPKQYVEHLNQNTGNTNEAINIYFVPSDLVNPTISVGNYTNHQVFSGETFTNTITANDNFGVQSVTVPATSQLTGTVDNNHQHVSATAPNVTSATNKTINLVATDTSGNTATTSFNVTIKPLRDKYRVGTSSTAANPVRIANISNNATVSQADQTAIINSLTFTETVPNRSYARASTNEITSKTVSNVSRIGNNANVTVTVTYQDGTTSTVTVPVKHVIPEIVAHSHYIVQGQDFPAGNGSSASDYFKLSNGSAIPDATITWSGQAPNKNNTTIGQDINVTAHILIDGETTPITKTATYKVVSSVPKHVFETNRGAVFPGVSDVYDAKQYVKPVNNSWTQNAQHMNFQFTNSYGPSKDVVGISTRDIRVTYDNHQTQIIKILAKVKPDPPRIDGNSVTYKAGLTNQQIKINNVLSSSSIKLFKADNTPLTITNTTYGSGNTAVVTVSDALPNGEIKARSSISMNNVTYTTQDEHGRAIDVTRNESVDSNDSASVHVTPQLQATSQGPVFIKGGDDFDFGHVERFIQNPPHGATVAWQDSPDTWKNTVGNTHKTAVVTLPNGQGTRNVEVPVKVYPVANAKAPSRDVKGQNLTHGTNAIDYITFDPNTNTNGITATWANRQQPNNQQAGVQNLNVDVTYPGISATKRVPVTVNVYQFESPQNSYTTTVGGTLASGIQASGYAQMQNATGLPTDGFTYKWNNAATGTNDANWAAMNKPNMAKVVNAKYDVIYNGHTFATSLPAKFVVKDVQPAKPTVTETAAGAITIAPGANQTVNTHAGNVTTYADKLVIKRNGSVVTTFTRHNNTSPWVKEASAANVAGIAGTNNGITVAAGTFNPADTIQVVATQGSGETISDEQRSDDFTVVAPQPNQATTKIWQNGHIDITPNNPSGHLINPTQAMDIAYTEKVGNGAEHSKTLSVVRGQNNQWTIANKPDYVTLDAHTGKVTFNANTIKPNSTITITPKAGTGHSASSNPSTLTAPATHTVNTTEIVKDYGSNVTVAEINNAVQVANKRTATIKNGTAMPTNLAGGSTTTIPVTVTYNDGSTEEVQETIFTKADKRELITAINHLDDPVSTEGKKPGTITQYNNAIHNAQQQINAAKTEAQQVINNERATPQQVSDALTKVRAAQTKINEAKALLQNKEDNSQLVTSKNNLQSSVNQVPSTTGMTQQSIDNYNAKKREAESEITAAQRVIDNGDATAQQISDEKHRVDNALTALNQAKQNLTADTHELEQAVHQLNRTGTTTGKKPASITAYNNSIRALQSDLTSAKNSANAIIQKPIRTVQEVQSALTNVNRVNDKITQAINQLVPLADNSALRTAKTKLDEEINKSVTTDGMTQSSIQAYENAKRAGQTESTNAQNVINNGDATDQQIAAEKAKVEEKYNSLKQAIAGLTPDLAPLQTAKTQLQNDIDQPTSTTGMTSASVASFNDKLSAARTKIQEIDRVLASHPDV

SEQ ID NO: 34210 - protein, 257 aa, Staphylococcus aureus; identical to SEQ ID NO: 30420
  subsp. aureus 21202

SEQ ID NO: 34211 - protein, 327 aa, Staphylococcus aureus
  subsp. aureus 21202
MKMKKLIKSSVATSVALIMLSNTVDAAQHITPVSEKKVDDKITLYKTTATSDNDKLNISQILTFNFIKDKSYDKDTLVLKAAGNINSGYKKPNPNDHNYSYFYWGAKYNVSVSSESNDSVNVVDYAPKNQNEEFQVQQTLGYSYGGDINITNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNEAKKSKIKVTYQREMDRYTNYWNRLHWIGNNHKNQNTVTFTSTYEVDWQNHTVKLLGTDSKETAPGV

SEQ ID NO: 34212 - protein, 306 aa, Staphylococcus aureus
  subsp. aureus 21202
MLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGAFNYSKTISYTQKSYVSEVDKQNSKSVKWGVKANEFVTPDGKKSAHDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 34213 - protein, 321 aa, Staphylococcus aureus; identical to SEQ ID NO: 31900
  subsp. aureus 21202

SEQ ID NO: 34214 - protein, 315 aa, Staphylococcus aureus
  subsp. aureus 21202
MLKNKILATTLSVSLLAPLANPLLENARAANDTEDIGKGNDVEIIKRTEDKTSNKWGVTQNIQFDFVKDKKYNKDALILKMQGFISSRTTYYNYKNTNHIKSMRWPFQYNIGLKTNDPNVSLINYLPKNKIESTNVSQTLGYNIGGNFQSAPSLGGNGSFNYSKSISYTQQNYVSEVEQQNSKSVLWGVKANSFVTASGQKSAFDSDLFVGYKPHSKDPRDYFVPDSELPPLVQSGFNPSFIATVSHEKGSGDTSEFEITYGRNMDVTHAIKRSTHYGNSYLDGHRIHNAFKNRNYTVKYEVNWKTHEIKVKGQN

SEQ ID NO: 34215 - protein, 325 aa, Staphylococcus aureus
  subsp. aureus 21202
MNMNKLVKSSVATSMALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFISQHQMPLLSRSNFNPEFLSVLSHRQDGAKKSKITVTYQREMDLYQIRWNGFYWAGANYKNYKTRTFKSTYEIDWENHKVKLLDTKETEINK

SEQ ID NO: 34216 - protein, 234 aa, Staphylococcus aureus; identical to SEQ ID NO: 30395
  subsp. aureus 21202

SEQ ID NO: 34217 - protein, 291 aa, Staphylococcus aureus; identical to SEQ ID NO: 30390
  subsp. aureus 21202

SEQ ID NO: 34218 - protein, 2182 aa, Staphylococcus aureus
  subsp. aureus 21202
MNLLKKNKYSIRKYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLAANNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAILGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNVTYDATNRVITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSATGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASAVNQVESIKDTPHATTDELDEANQQINDTLKQGQQNIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEATDEEQNAAIAQVEQALIKAKQHIASAVTNADVAYLLHDGKNEIREIEPVINRKASAREQLTTLLNDKKQAIEANVQATVEERNSVLAQLQNIYDAAIGQLDHDRSNAQVDKTASFNLQTIQGLDVHPVKKPEAEKTINQDIARVTHLVQNYRKVSDRNKADALKAITALKLQMDEELKTARTNADVDAVLKRFNVALGDIEAVITEKEHSLMRIENIAQQTYAKFKAIATPEQLAKVKALIDQYVADGNRMIDEDATLNDIKQHTQFIIDEILAIKLPAEVIKASPKVGQLAPKVCTPIKKEDKQEVRKVEKELPNTGSEEMDLPLKELALITGAALLARRRTKNEKES

SEQ ID NO: 34219 - protein, 331 aa, Staphylococcus aureus
  subsp. aureus 21202
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADLTIKNKGKEALTIDSSMFKLKSGDKTFEADNTGSMSANQNDNGSIENSFFLQRINPDSTAQGKIVFDVSESVANAKDKKLEVISSLFSVKKITFDLSDAKKTSKAKKDKQDTEVAVASSNSDNVNYEASATAPATTSSADTDSEESEKSSKDEDKQNASKSDKSSVEKSESNEETTPVEPMPHSKPTTSEAPPSQNIHNEDSMYDASTE

SEQ ID NO: 34220 - protein, 807 aa, Staphylococcus aureus
  subsp. aureus 21202
MTYKMKKWQKLSTITLLMAGVITLNNGEFRNVDKHQIAVADTNVQTPDYEKLKKTWLDVNYGYDQYDENNQDMKKKFDAKENEAKKLLEDMKTDTNRTYLWSGAENLETNSSHMTKTYRNIEKIAEAMRHKNTSLKTDENKLKIKEALDWMHKNVYGKNPSQKVTDLTTNRKEKDSSKKNNSLNWWDYEIGTPRALTNTLLLMDDMLTKDEMKNYSKPISTYAPSSDKILSSVGESEDAKGGNLVDISKVKLLESVIEEDETMMKKSIDSFNKVFTYVQDSATGKGRNGFYKDGSYIDHQDVPYTGAYGVVLLEGISQILPMIKETPFKTTQDNATLSNWIDEGFMPLIYKGEMMDLSRGRAISRENETSHTASATVMKSLLRLSDTMDDSTKAKYKQIVKTSVNSDSSYDSNVTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIIKQDEDFHVIKDNDGVFAGVNYSDSTKSFDINGTIVDLKEKGMFVIKKKDDNTYECSFYNPPSTNSTSNKESKISVTGYTITNQSVSNFKESDIHFELTK

SEQ ID NO: 34221 - protein, 257 aa, Staphylococcus aureus
  subsp. aureus 21202
MKKTAFILLLFIALTLTTSPLVNGSEKSEEINEKDLRKKSELQGTALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNQLEEEKKVPINLWIDGKQNTVPLGTVKTNKKEVTVQELDLQSRHYLQEKYNLYNSDVFDGKVQRGLIVFHTSTEPSVNYDLFGAQGQHSNTLLRIYRDNKTINSENMHIDIYLYTS

SEQ ID NO: 34222 - protein, 1041 aa, Staphylococcus aureus
  subsp. aureus 21202
MNMKKQEKHAIRKKSIGVASVLVGTLIGFGLLSSKEADASENSVTQSDSASNESKSNDSSSVNAAPKTDNTNVSDSNTTTNTNSDETNVAQNPAQQETKQSASTNATTEETPVTGEVTTTATNQANTPTTTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSASDSDSASDSDSTSDSDSASDSDSTSDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSASDSDSDSDSDSASDSDSDSDSDSDSASDSDSDSDSVSDSDSDSDSDSDSDSESDSDSDSDSDSESDSDSDSASDSDSGSDSDSDNDSDSDSDSNSDSDSDSDSDSDSDSDSESDSASDSDSDSDSTSDTGSDNDSDSESDSNSDSESGSNNNVVPPNSPKNSTNASNKNEAKDSKEPLPDTGSEDEANTSLIWGLLASLGSLLLFRRKKENKDKN

SEQ ID NO: 34223 - protein, 240 aa, Staphylococcus aureus; identical to SEQ ID NO: 30548
  subsp. aureus 21202

SEQ ID NO: 34224 - protein, 266 aa, Staphylococcus aureus; identical to SEQ ID NO: 30409
  subsp. aureus 21202

SEQ ID NO: 34225 - protein, 689 aa, Staphylococcus aureus
  subsp. aureus 21202
MKFKSLITTTLALGVIASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKVNNQVPYSINLNGTTTNIQSNLAFSNKPWTNYKNLTTKVKSVLKSDRGVSERDLKHAKKAYYTVYFKNGGKRVIHLNSNIYTANLVHAKDVKRIEVTVKTVSKVKAERYVPYTIAVNGASNPTLSDLKFTGDSRVSYSDIKKKVKSVLKHDRGIGERELKYAKKATYTVHFKNGTKKVINLNSNISQLNLLYVKDIKNIDIDVKTGAKAKADSYVPYTIAVNGTTTPIASKLKLSNKQLIGYQDLNKKVKSVLKHDRGINDIELKFAKQAKYTIHFKNGKTQVVDLKSDIFTRNLFSVKDIKKIDINVKQQSKSNKALNKVTNKATKVKFPVTINGFSNLVSNEFAFLHPHKITTNDLNAKLRLALASDQGITKHDIGLSERTVYKVYFKDGSSKFVDLKAAKQDSKVFKATDIKKVDIEIKF

SEQ ID NO: 34226 - protein, 233 aa, Staphylococcus aureus; identical to SEQ ID NO: 32856
  subsp. aureus 21202

SEQ ID NO: 34227 - protein, 889 aa, Staphylococcus aureus
  subsp. aureus 21202
MNNKKTATNRKGMIPNRLNKFSIRKYSVGTASILVGTTLIFGLSGHEAKAAEHTNGELNQSKNETTVPTENKTTEKVDRRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDADNWTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDS

SEQ ID NO: 34228 - protein, 259 aa, Staphylococcus aureus
  subsp. aureus 21202
MRKVFILITLLFGYSSYSLLQAKAETQNDPNISELNKSSQYTGSWHNIWYLYNSDPVNAKKIKLSDKFLSHDFIVPINSPGHYDYVKTELKDSTMASSFDGKEVDIFGVNYFDQCYFSNENIQCDSNQGAGSKKTCMYGGITLNENNTNNRIQPIVVKVYENDSVTLSFDINIDKETVTIQELDYKVRNKLISKINLYHLGGTSYETGYIKFIENGNRYYWYDMMPDPGFTQSKYLMIYRGNETVESAKTEIEVHLTKK

SEQ ID NO: 34229 - protein, 508 aa, Staphylococcus aureus
  subsp. aureus 21202
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDNKKPGKEDGNKPGKEDNKKPGKEDGNKPGKEDGNKPGKEDNKKPGKEDGNKPGKEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 34230 - protein, 372 aa, Staphylococcus aureus
  subsp. aureus 21202
MNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVINNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 34231 - protein, 241 aa, Staphylococcus aureus; identical to SEQ ID NO: 32827
  subsp. aureus 21202

SEQ ID NO: 34232 - protein, 241 aa, Staphylococcus aureus
  subsp. aureus 21202
MKNNLTKKIILSIALTMIGTATSQSPHSPISMSSEAKAYNISENETNVNELTKYYTQRHLTFSNKWLWQKENGTIHATLLQLSWFSHIQVFGPESWGNINQLRNKYVDIFALKDYETWHTYMLAQETFTGGVTPAAKPSDKHYKLNLTYKDKSGTFIGEHPFYTGNKPVLTLKEVDFRIRQTLIKNKKLYHGNYNKGHIKITGGNNNYTIDLNKRLKSTDANRYVKNPQTAHIEILLEKSN

SEQ ID NO: 34233 - protein, 238 aa, Staphylococcus aureus; identical to SEQ ID NO: 32829
  subsp. aureus 21202

SEQ ID NO: 34234 - protein, 319 aa, Staphylococcus aureus; identical to SEQ ID NO: 32830
  subsp. aureus 21202

SEQ ID NO: 34235 - protein, 165 aa, Staphylococcus aureus
  subsp. aureus 21202
MKNKLIAKSLLTIAVIGMTATTLASTADASEGYGPREKKPVSINHNIVEYNDGTFKYQSRPKFNTTPQYIKFRHDYNIVEYNDGTFGYGPRPHFNKPAEKSDATIKKEQKLIQAQNLVKEFEKTHTVSAHRKAQKAVNLVSFEYNVKKMILQERIDQVLKQGLVR

SEQ ID NO: 34236 - protein, 109 aa, Staphylococcus aureus; identical to SEQ ID NO: 30603
  subsp. aureus 21202

SEQ ID NO: 34237 - protein, 350 aa, Staphylococcus aureus
  subsp. aureus 21202
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKAENTQTTKVVSTEATKDQSQTHSARTVKTTQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 34238 - protein, 641 aa, Staphylococcus aureus
  subsp. aureus 21202
MNKQQKEFKSFYSIRKSSLGVASVAISTLLLLMSNGEAKAAEETGGTNTETQPKTEAVASPTTTTEKAPEAKPVANAVSVSNKEVKAPTSETKEVKEVKAPKEAKEEKPAAKSDNNTYPILNEELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTAPVEKESQKQDSQKDDNKQSPSVEKEIDASSESGKDKTPATKPAKGEVESSSTTPTKVVSATQNVAKPTSASSETTKGVVQTSAGSSEAKDNAPLQKANIKNTNDGHTQSQNNKNTQENKAKSLPQTGEESNKDMTLPLMALLALSSIIAFVLPRKRKN

SEQ ID NO: 34239 - protein, 434 aa, Staphylococcus aureus [sequence omitted]

SEQ ID NO: 34240 - protein, 94 aa, Staphylococcus aureus; identical to SEQ ID NO: 32817
  subsp. aureus 21202

SEQ ID NO: 34241 - protein, 2466 aa, Staphylococcus aureus
  subsp. aureus 21202
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAVGAAQPAAGTTQPAAGTTQPAGQGNQADPNNAVQAQPGNQAAPANQAGQGNNQATPNNAAPANQTQPANAPAAAQPAAPVAANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLKDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANNHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQQINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKATQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 34242 - protein, 1075 aa, Staphylococcus aureus
  subsp. aureus 21202
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGIQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLT

SEQ ID NO: 34243 - protein, 128 aa, Staphylococcus aureus
  subsp. aureus 21202
SDSDSESDSDSDSDSDSDSDSDSDSDSDSDSDSDSDSDSDSDSDSDSDSDSDSDSDSDSDSDSDSDSNAGKHTPAKPMSAVKDHNNKAKALPETGTENNGSNNATLFGGLFAVLGSLLLFGRRKKQNK

SEQ ID NO: 34244 - protein, 231 aa, Staphylococcus aureus
  subsp. aureus 21202
MKKTLLASSLAVGLGIVAGNAGHEAHASEADLNKASLAQMAQSNDQTLNQKPIEAGVYNYTFDYEGFTYHFESDGTHFAWNYHATGANGTDMSAQAHATNNVVPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 34245 - protein, 54 aa, Staphylococcus aureus
  subsp. aureus 21202
MKPMSATKDHHKKAKALPETGSENNGSNNATLFGGLFAALGSLLLFGRRKKQNK

SEQ ID NO: 34246 - protein, 896 aa, Staphylococcus aureus
  subsp. aureus 21202
MINRDNKKAITKKGMISNRLNKFSIRKYTVGTASILVGTTLIFGLGNQEAKAAENTSTENAKQDDATTSDNKEVVSETENNSTTENNLTNPIKKETNTDSQQEAKEAPTTSSTQQQQNNATTSTETRPQNIEKENVQPSTDKTATEDTSVILEEKKAPNNTNNDVTTKPSTSEIQTTPTTPQESTKIENSQPQATPSKVDNQVTDATNPKESVNVSKEELKNNPEKLKELVRNDSNTDRSTKPVAIAPTSVTPKRVNAKMRFAVAQPAAVASNNVNDLIKVTKQTIKVGDDEDNVVSAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGYYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDTTEKGIKDVTVTLQNEKGEVIGTTKTDENGKYRFDNLDSGKYKVIFEKPAGLT

SEQ ID NO: 34247 - protein, 159 aa, Staphylococcus aureus
  subsp. aureus 21202
DSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSESDSDSDTGKHTPVKPMSATKDHHNKAKALPETGSENNGSNNATLFGGLFAALGSLLLFGRRKKQNK

SEQ ID NO: 34248 - protein, 681 aa, Staphylococcus aureus
  subsp. aureus 21202
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKNQLKDDKKSSLNNKNIQRDTTKNNNANPSDVNQGLEQAINDGKQSKAASQQQAKEAANSQGSNANNNLPLQSRTKESTSLNKSDQKSQPEIVRETEIEKVQPQQKNQSNDKMTSHHFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKIHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34249 - protein, 2273 aa, Staphylococcus aureus
  subsp. aureus 21202
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKIRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSISTSESDSQSTSTYTSQSTSQSESTSTSTSISDSTSISKSTSQSGSTSTSASLSGSESESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSASMSQDKSDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSDSQSTLSATSEATKHNGTRAQSEERLPDTGESIKQNGLLGGIMTLLVGLGLMKRKKKKDENDQDDSQA

SEQ ID NO: 34250 - protein, 854 aa, Staphylococcus aureus
  subsp. aureus 21202
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPDPEPSPGPDPEPTPDPEPSPEPDPDSDSDSDSDSDSDSDSDSGSDSDSDSDSESDSDSDSDSGSDSDSDSESDSDSDSDSDSDSDSDSDSDSDSDSDSDSDSDSGSDSDSDSDSDSDSDSDSDSDSESDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSES

SEQ ID NO: 34251 - protein, 343 aa, Staphylococcus aureus
  subsp. aureus 21202
MKIRTIVKTSLALSLITTGTSIVTTQSAKAEVASALKSEQLAMISVSPSAITTTTQAVNAEQNRTANPEQAPKSNTENVSTSLSTKTEQALKSNIQKATQQTPSGTTQPSPNAQPQSPQPTPNPTTPPSSNVETQQPQSPTTKQAQKEINPKYKDLRTYYTKPSLEFKNELGIIIKKWTTIRFMNIVPDYFIYKIALVGKDDKKYGEGVHRHVDVFIVLEQNKYGVDKYSVGGITKANRKKVDYKAGISITKEDKNGTISHDVSEYKITKEEISLKELDFKLRKQLIEQHNLYGNIGSGTIVIKMKNGGKYTFELHKKLQEHRMADVIDGTNIDRIEVNLKSS

SEQ ID NO: 34252 - protein, 233 aa, Staphylococcus aureus; identical to SEQ ID NO: 32849
  subsp. aureus 21202

SEQ ID NO: 34253 - protein, 226 aa, Staphylococcus aureus
  subsp. aureus 21202
MKFKAIAKASLALGMLATGVITSNTQSVQAKTEVKQQSESELKHYYNKPILERKNVTGYKYTEHGKDYIDVIVDNQYSQIALLGSDKDKFKDGENSNIDVFILREGDSRQATNYSIGGVTKTNSVQYIDYINTPILEIKKGNEDVLKDFYYISKENISLKELDYRLRERAIKQHGLYSNGLKQGRITITMKDGKSHTIDLSQKLEKERMGESIDGTKIDKILVEIK

SEQ ID NO: 34254 - protein, 55 aa, Staphylococcus aureus
  subsp. aureus 21202
MPKDNIVINTKNGGKYTLESHKELQKDRENVKINTADIKNVTFKLVKSVNDIEQV

SEQ ID NO: 34255 - protein, 231 aa, Staphylococcus aureus
  subsp. aureus 21202
MKLKNIAKASLALGILTTGMITTTAQPVKASESSSLSIITKNTKDLKDYYNGPTFSHKNISGYKEEDKVIFTPNMQQVSVKLTGKENLKFNDEDVVSNVDVFVVRENSDKSGNTFSIGGITKTNSQDNIDNVKSVNMQITKKISSNAETVTSSYYSIDKENISLKELDFKLRKHLIDNNGLYNTEPKDSKIKVTMQNGDFYTFELNKKLQEHRMGDVIDGTKIKEINVELN

SEQ ID NO: 34256 - protein, 227 aa, Staphylococcus aureus
  subsp. aureus 21202
MKLTVLAKATLALGILTTGTLTTEAHSGHAKQIHKSVNKHDKEALHRYYSGNFKEMKNINALKHGKNNLRFKYRGMKTQVLLPGDEYRKYQQRRHTGLDVFFVQERRDKHDISYTVGGVTKTNKTSGFVSTPRLNVIKENGEDAFVRGYPYDIKKEEISLKELDFKLRKHLIEKYGLYKTISKHGSVKINMKDGSFYNLNLRCKLEFKYMGEVIESKQIKDIEVNLK

SEQ ID NO: 34257 - protein, 232 aa, Staphylococcus aureus
  subsp. aureus 21202
MKLTVLAKATLALGILTTGVMTAESQTVNAKVKLDETQRKYYINMLKDYYSQESYESTNISVKSEDYYGSNVLNFNQRNKTFKVFLIGDDRNKYKELTHGLDVFAVPELIDTNGGIYTVGGITKKNVRSVFGYVSHPGLQVKKVDPKDGFSIKELFFIQKEEVSLKELDFKIRKMLVEKYRLYKGASDKGRIVINMKDEKKHEIDLSEKLSFDRMFDMLDSKQIKNIEVNLN

SEQ ID NO: 34258 - protein, 231 aa, Staphylococcus aureus
  subsp. aureus 21202
MKLKTLAKATLALGLLTTGVITLEGQAVKAAEKQERVQHLYDIKDLYRYYSAPSFEYSNISGKVENYNGSNVVRFNQKDQNHQLFLLGKDKEQYKEGLQGKDVFVVQELIDPNGRLSTVGGVTKKNNKTSETKTHLLVNKVDGGNLDASIDSFLIQKEEISLKELDFKIRQQLVEKYGLYQGTSKYGKITINLKDEKREVIDLSDKLEFERMGDVLNSKDIKGISVTINQI

SEQ ID NO: 34259 - protein, 234 aa, Staphylococcus aureus
  subsp. aureus 21202
MKMTAIAKASLALSILATGVITSTAQTVNASEHESKYENVTKDIFDLRDYYSGASKELKNVTGYRYSKGGKHYLIFDKNRKFTRIQIFGKDIERLKARKNPGLDIFVVKEAENRNGTVYSYGGVTKKNKGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIDKIEANIR

SEQ ID NO: 34260 - protein, 343 aa, Staphylococcus aureus
  subsp. aureus 21202
MKIRTIVKTSLALSLITTGTSIVTTQSANAEVASALKAGQLAKINLSPSAITTTTQAVNAEQNRTANTEQASKSNTENVSTSPSTKTEQTPKSNIQKATQQTPSVATPPSPNAQPQSPQPTPKPTTPPSSNVETQQPQSPTTKQAQKKINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKIDYKAELSITKKDEEGKISRDVSEYKITKEEISLKELDFKLRKQLIEQHNLYGNIGSGTIVIKTKNGGKYTFELHKKLQEHRMADVIDGTSIDRIEVNLTSS

SEQ ID NO: 34261 - protein, 691 aa, Staphylococcus aureus
  subsp. aureus 21202
MLRGQEERKYSIRKYSIGVVSVLAATMFVVSSHEAQASEKTPTSNAAAQKETLNQSGEQGNAITSHQMQSGKQLDDMHKKNDKSGTVTEGKDTLQSSKHQSTQNSKTIGTQNDDQVKQDSERQGSKQSHQNNATNKTERQNDQVQNTHHAERNGSQSTTSQSNDVDKSQPSIPAQKVITNHDKAATTSTTPPSNDKTAPKSTKTQDASTDKHPNQQDTHQPAHQIIDANQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGAELANFYIGIINDLLSVEATEGKGTQLKAS

SEQ ID NO: 34262 - protein, 807 aa, Staphylococcus aureus
  subsp. aureus 21202
MTYRMKKWQKLSTITLLMAGVITLSDGEFRSVDKHQIAVADTNTQTPNYEKLKNTWLDVNYGYDKYDESNPDMKKKFEATENEAKKLLSEMKTESGRTYLWESSKDIDTKSADMTRTYRNIEKIAEAMNHKDTKLNTQDNKNKVKDALEWMHKNAYGKEPDKKVADLTSNFKNKTSRNTNLNWWDYEIGTPRALTNTLLLLNGAISNDEKKKYTAPIKTFAPKSDKILSSVGQPEQAKGGNLVDISKVKLLESIIEEDATMMKESIDAFNKVFTYVQSNATGKERNGFYKDGSYIDHKDVPYTGAYGVVLLEGISQMMPMIKETPFNDSNQNDTTLKSWIDDGFMPLIYKGEMMDLSRGRAISRENETSHTASATVMKSLLRLSDAMDESTKAKYKQIVKTSVKSDSTYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATANMKQLAGTTTIENEEPKGMDVKKSSKTFVGGTKFDDQHASIGMDFENQDTTLTAKKSYFILNDKIVFLGTGIKSTDSSKNPVTTIENRKANGYTLYTDDKQTTTSNDQETNSVFLESTDTKKNIGYHFLNESKITVKKESHTGKWSDINKSQKQDSKTNQYYEVTQKHSNTDSKYAYVLYPGLSKDDFNTKKDKVTVVKQDDGFHVVKDNESVWAGVNYSNSTQTFDINNTKVEVKAKGMFILKKKDDKTYECSFYNPESTNTASDIESKISMTGYSITNKNTSTSNESGVRFELTK

SEQ ID NO: 34263 - protein, 141 aa, Staphylococcus aureus; identical to SEQ ID NO: 31189
  subsp. aureus 21202

SEQ ID NO: 34264 - protein, 242 aa, Staphylococcus aureus; identical to SEQ ID NO: 31066
  subsp. aureus 21202

SEQ ID NO: 34265 - protein, 242 aa, Staphylococcus aureus
  subsp. aureus 21202
MKKLISILLINIIILGVSNNASAQGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKFVTAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 34266 - protein, 871 aa, Staphylococcus aureus
  subsp. aureus 21202
MNKHHPKLRSFYSIRKSTLGVASVIVSTLFLITSQHQAQAAENTNTSDKISENQNNNATTTQPPKDTNQTQPATQPANTAKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVVTNDQSSSNASNQTNTNTSNQNTSTTNNANDQSQATTNMSQPAQPKSSVNSDQASSQPAHETNSNGNTNDASNASSNQLNGNQQYPPADESLQDAIKNPAIIDKEHTAYHWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENFHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTSEPLNVQTGQEDKVTATDTAENSSTATNPKDASDKADVIEPESDVVKDADSSVDKDVQNDVDHLSDMSDNNHFDKYDLKEMDTQIAKDTDKGVDNSVGMTSNIDTDKDSNKNKDKVIQLAHIADKNKVAGNRSTEHPSSDNHKTVDKTVKTKEKASTPSKENKLGQSKMLPKTGETTSSQSWWGLYALLGMLALFIPKFRKESK

SEQ ID NO: 34267 - protein, 250 aa, Staphylococcus aureus; identical to SEQ ID NO: 32837
  subsp. aureus 21202

SEQ ID NO: 34268 - protein, 434 aa, Staphylococcus aureus [sequence omitted]

SEQ ID NO: 34269 - protein, 895 aa, Staphylococcus aureus; identical to SEQ ID NO: 30734
  subsp. aureus 21209

SEQ ID NO: 34270 - protein, 134 aa, Staphylococcus aureus
  subsp. aureus 21209
SDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34271 - protein, 159 aa, Staphylococcus aureus
  subsp. aureus 21209
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34272 - protein, 973 aa, Staphylococcus aureus
  subsp. aureus 21209
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDS

SEQ ID NO: 34273 - protein, 225 aa, Staphylococcus aureus; identical to SEQ ID NO: 30763
  subsp. aureus 21209

SEQ ID NO: 34274 - protein, 2186 aa, Staphylococcus aureus; identical to SEQ ID NO: 33090
  subsp. aureus 21209

SEQ ID NO: 34275 - protein, 203 aa, Staphylococcus aureus; identical to SEQ ID NO: 30770
  subsp. aureus 21209

SEQ ID NO: 34276 - protein, 690 aa, Staphylococcus aureus; identical to SEQ ID NO: 30419
  subsp. aureus 21209

SEQ ID NO: 34277 - protein, 241 aa, Staphylococcus aureus; identical to SEQ ID NO: 30776
  subsp. aureus 21209

SEQ ID NO: 34278 - protein, 508 aa, Staphylococcus aureus
  subsp. aureus 21209
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNKKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34279 - protein, 227 aa, Staphylococcus aureus; identical to SEQ ID NO: 30585
  subsp. aureus 21209

SEQ ID NO: 34280 - protein, 232 aa, Staphylococcus aureus; identical to SEQ ID NO: 30765
  subsp. aureus 21209

SEQ ID NO: 34281 - protein, 232 aa, Staphylococcus aureus; identical to SEQ ID NO: 31054
  subsp. aureus 21209

SEQ ID NO: 34282 - protein, 231 aa, Staphylococcus aureus; identical to SEQ ID NO: 30560
  subsp. aureus 21209

SEQ ID NO: 34283 - protein, 231 aa, Staphylococcus aureus; identical to SEQ ID NO: 31761
  subsp. aureus 21209

SEQ ID NO: 34284 - protein, 234 aa, Staphylococcus aureus; identical to SEQ ID NO: 31052
  subsp. aureus 21209

SEQ ID NO: 34285 - protein, 133 aa, Staphylococcus aureus; identical to SEQ ID NO: 33100
  subsp. aureus 21209

SEQ ID NO: 34286 - protein, 331 aa, Staphylococcus aureus; identical to SEQ ID NO: 30732
  subsp. aureus 21209

SEQ ID NO: 34287 - protein, 311 aa, Staphylococcus aureus; identical to SEQ ID NO: 30617
  subsp. aureus 21209

SEQ ID NO: 34288 - protein, 327 aa, Staphylococcus aureus; identical to SEQ ID NO: 30538
  subsp. aureus 21209

SEQ ID NO: 34289 - protein, 250 aa, Staphylococcus aureus; identical to SEQ ID NO: 31910
  subsp. aureus 21209

SEQ ID NO: 34290 - protein, 291 aa, Staphylococcus aureus
  subsp. aureus 21209
MKKIEAWLSKKGLKNKRTLIVVIAFVLFIIFLFLLLNSNSEDSGNITITENAELRTGPNAAYPVIYKVEKGDHFKKIGKVGKRIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 34291 - protein, 807 aa, Staphylococcus aureus; identical to SEQ ID NO: 30716
  subsp. aureus 21209

SEQ ID NO: 34292 - protein, 141 aa, Staphylococcus aureus; identical to SEQ ID NO: 30715
  subsp. aureus 21209

SEQ ID NO: 34293 - protein, 266 aa, Staphylococcus aureus; identical to SEQ ID NO: 30401
  subsp. aureus 21209

SEQ ID NO: 34294 - protein, 242 aa, Staphylococcus aureus; identical to SEQ ID NO: 30537
  subsp. aureus 21209

SEQ ID NO: 34295 - protein, 242 aa, Staphylococcus aureus; identical to SEQ ID NO: 30536
  subsp. aureus 21209

SEQ ID NO: 34296 - protein, 933 aa, Staphylococcus aureus; identical to SEQ ID NO: 30755
  subsp. aureus 21209

SEQ ID NO: 34297 - protein, 444 aa, Staphylococcus aureus; identical to SEQ ID NO: 32034
  subsp. aureus 21209

SEQ ID NO: 34298 - protein, 917 aa, Staphylococcus aureus
  subsp. aureus 21209
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKRNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 34299 - protein, 995 aa, Staphylococcus aureus; identical to SEQ ID NO: 31038
  subsp. aureus 21209

SEQ ID NO: 34300 - protein, 1179 aa, Staphylococcus aureus
  subsp. aureus 21209
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDRDSDSDSDSDSDSDSDST

SEQ ID NO: 34301 - protein, 134 aa, Staphylococcus aureus
  subsp. aureus 21209
SDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 34302 - protein, 351 aa, Staphylococcus aureus; identical to SEQ ID NO: 30720
  subsp. aureus 21209

SEQ ID NO: 34303 - protein, 338 aa, Staphylococcus aureus; identical to SEQ ID NO: 30699
  subsp. aureus 21209

SEQ ID NO: 34304 - protein, 274 aa, Staphylococcus aureus; identical to SEQ ID NO: 30872
  subsp. aureus 21209

SEQ ID NO: 34305 - protein, 231 aa, Staphylococcus aureus; identical to SEQ ID NO: 30768
  subsp. aureus 21209

SEQ ID NO: 34306 - protein, 226 aa, Staphylococcus aureus; identical to SEQ ID NO: 30769
  subsp. aureus 21209

SEQ ID NO: 34307 - protein, 830 aa, Staphylococcus aureus
  subsp. aureus 21209
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 34308 - protein, 233 aa, Staphylococcus aureus; identical to SEQ ID NO: 30428
  subsp. aureus 21209

SEQ ID NO: 34309 - protein, 161 aa, Staphylococcus aureus
  subsp. aureus 21209
DSDSDSDSDSDSDSDSDSDSDSDSDSDSDSYSDSDSDSDSDSDSDSDSDSDSDSDSDSDSDSDSDSDSDSDSDSDSDSDSDSDSDSDSRVTPPNNEQKTPSNPKGEVNHSNKVSKQHKTDALPETGDKSENTNATLFGAMMALLGSLLLFRKRKQDHKEKA

SEQ ID NO: 34310 - protein, 372 aa, Staphylococcus aureus; identical to SEQ ID NO: 31084
  subsp. aureus 21209

SEQ ID NO: 34311 - protein, 241 aa, Staphylococcus aureus; identical to SEQ ID NO: 30738
  subsp. aureus 21209

SEQ ID NO: 34312 - protein, 241 aa, Staphylococcus aureus; identical to SEQ ID NO: 30739
  subsp. aureus 21209

SEQ ID NO: 34313 - protein, 238 aa, Staphylococcus aureus; identical to SEQ ID NO: 30740
  subsp. aureus 21209

SEQ ID NO: 34314 - protein, 319 aa, Staphylococcus aureus; identical to SEQ ID NO: 30741
  subsp. aureus 21209

SEQ ID NO: 34315 - protein, 165 aa, Staphylococcus aureus; identical to SEQ ID NO: 30742
  subsp. aureus 21209

SEQ ID NO: 34316 - protein, 109 aa, Staphylococcus aureus; identical to SEQ ID NO: 30744
  subsp. aureus 21209

SEQ ID NO: 34317 - protein, 350 aa, Staphylococcus aureus; identical to SEQ ID NO: 30602
  subsp. aureus 21209

SEQ ID NO: 34318 - protein, 645 aa, Staphylococcus aureus; identical to SEQ ID NO: 30747
  subsp. aureus 21209

SEQ ID NO: 34319 - protein, 321 aa, Staphylococcus aureus; identical to SEQ ID NO: 30959
  subsp. aureus 21209

SEQ ID NO: 34320 - protein, 315 aa, Staphylococcus aureus; identical to SEQ ID NO: 30440
  subsp. aureus 21209

SEQ ID NO: 34321 - protein, 325 aa, Staphylococcus aureus; identical to SEQ ID NO: 30407
  subsp. aureus 21209

SEQ ID NO: 34322 - protein, 253 aa, Staphylococcus aureus
  subsp. aureus 21209
KGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 34323 - protein, 231 aa, Staphylococcus aureus; identical to SEQ ID NO: 31073
  subsp. aureus 21209

SEQ ID NO: 34324 - protein, 2478 aa, Staphylococcus aureus; identical to SEQ ID NO: 33089
  subsp. aureus 21209

SEQ ID NO: 34325 - protein, 257 aa, Staphylococcus aureus; identical to SEQ ID NO: 30259
  subsp. aureus 21209

SEQ ID NO: 34326 - protein, 681 aa, Staphylococcus aureus; identical to SEQ ID NO: 32025
  subsp. aureus 21209

SEQ ID NO: 34327 - protein, 1503 aa, Staphylococcus aureus; identical to SEQ ID NO: 33069
  subsp. aureus 21209

SEQ ID NO: 34328 - protein, 754 aa, Staphylococcus aureus
  subsp. aureus 21209
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSYSDSDS

SEQ ID NO: 34329 - protein, 225 aa, Staphylococcus aureus; identical to SEQ ID NO: 30763
  subsp. aureus 21232

SEQ ID NO: 34330 - protein, 226 aa, Staphylococcus aureus; identical to SEQ ID NO: 30769
  subsp. aureus 21232

SEQ ID NO: 34331 - protein, 154 aa, Staphylococcus aureus
  subsp. aureus 21232
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPI

SEQ ID NO: 34332 - protein, 83 aa, Staphylococcus aureus
  subsp. aureus 21232
MTFFPFKIDKEAMSLKEIDFKLRKYLIDNYGLYGEMSTGKITVKKKYYGKYTFELDKKLQEDRMSDVINVTDIDRIEIKVIKA

SEQ ID NO: 34333 - protein, 352 aa, Staphylococcus aureus; identical to SEQ ID NO: 30767
  subsp. aureus 21232

SEQ ID NO: 34334 - protein, 308 aa, Staphylococcus aureus; identical to SEQ ID NO: 31787
  subsp. aureus 21232

SEQ ID NO: 34335 - protein, 234 aa, Staphylococcus aureus; identical to SEQ ID NO: 31052
  subsp. aureus 21232

SEQ ID NO: 34336 - protein, 231 aa, Staphylococcus aureus; identical to SEQ ID NO: 31761
  subsp. aureus 21232

SEQ ID NO: 34337 - protein, 231 aa, Staphylococcus aureus; identical to SEQ ID NO: 30560
  subsp. aureus 21232

SEQ ID NO: 34338 - protein, 232 aa, Staphylococcus aureus; identical to SEQ ID NO: 31054
  subsp. aureus 21232

SEQ ID NO: 34339 - protein, 232 aa, Staphylococcus aureus; identical to SEQ ID NO: 30765
  subsp. aureus 21232

SEQ ID NO: 34340 - protein, 227 aa, Staphylococcus aureus; identical to SEQ ID NO: 30585
  subsp. aureus 21232

SEQ ID NO: 34341 - protein, 690 aa, Staphylococcus aureus; identical to SEQ ID NO: 30419
  subsp. aureus 21232

SEQ ID NO: 34342 - protein, 203 aa, Staphylococcus aureus; identical to SEQ ID NO: 30770
  subsp. aureus 21232

SEQ ID NO: 34343 - protein, 681 aa, Staphylococcus aureus; identical to SEQ ID NO: 32025
  subsp. aureus 21232

SEQ ID NO: 34344 - protein, 372 aa, Staphylococcus aureus; identical to SEQ ID NO: 31084
  subsp. aureus 21232

SEQ ID NO: 34345 - protein, 234 aa, Staphylococcus aureus; identical to SEQ ID NO: 30395
  subsp. aureus 21232

SEQ ID NO: 34346 - protein, 256 aa, Staphylococcus aureus; identical to SEQ ID NO: 30531
  subsp. aureus 21232

SEQ ID NO: 34347 - protein, 242 aa, Staphylococcus aureus; identical to SEQ ID NO: 30396
  subsp. aureus 21232

SEQ ID NO: 34348 - protein, 319 aa, Staphylococcus aureus; identical to SEQ ID NO: 30741
  subsp. aureus 21232

SEQ ID NO: 34349 - protein, 165 aa, Staphylococcus aureus; identical to SEQ ID NO: 30742
  subsp. aureus 21232

SEQ ID NO: 34350 - protein, 109 aa, Staphylococcus aureus; identical to SEQ ID NO: 30744
  subsp. aureus 21232

SEQ ID NO: 34351 - protein, 350 aa, Staphylococcus aureus; identical to SEQ ID NO: 30602
  subsp. aureus 21232

SEQ ID NO: 34352 - protein, 645 aa, Staphylococcus aureus; identical to SEQ ID NO: 30747
  subsp. aureus 21232

SEQ ID NO: 34353 - protein, 991 aa, Staphylococcus aureus
  subsp. aureus 21232
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDS

SEQ ID NO: 34354 - protein, 1375 aa, Staphylococcus aureus
  subsp. aureus 21232
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34355 - protein, 947 aa, Staphylococcus aureus
  subsp. aureus 21232
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFSGLFAALGSLLLFGRRKKQNK

SEQ ID NO: 34356 - protein, 331 aa, Staphylococcus aureus; identical to SEQ ID NO: 30732
  subsp. aureus 21232

SEQ ID NO: 34357 - protein, 895 aa, Staphylococcus aureus; identical to SEQ ID NO: 30734
  subsp. aureus 21232

SEQ ID NO: 34358 - protein, 241 aa, Staphylococcus aureus; identical to SEQ ID NO: 30738
  subsp. aureus 21232

SEQ ID NO: 34359 - protein, 241 aa, Staphylococcus aureus; identical to SEQ ID NO: 30739
  subsp. aureus 21232

SEQ ID NO: 34360 - protein, 238 aa, Staphylococcus aureus; identical to SEQ ID NO: 30740
  subsp. aureus 21232

SEQ ID NO: 34361 - protein, 692 aa, Staphylococcus aureus
  subsp. aureus 21232
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDS

SEQ ID NO: 34362 - protein, 2271 aa, Staphylococcus aureus
  subsp. aureus 21232
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNNTVKMTNAGQSVTYYFTDVKAPTVTVGNQTIEVGKTMNPIVLTTTDNGTGTVTNTVTGLPSGLSYNSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 34363 - protein, 933 aa, Staphylococcus aureus; identical to SEQ ID NO: 30755
  subsp. aureus 21232

SEQ ID NO: 34364 - protein, 434 aa, Staphylococcus aureus [sequence omitted]

SEQ ID NO: 34365 - protein, 291 aa, Staphylococcus aureus; identical to SEQ ID NO: 30390
  subsp. aureus 21232

SEQ ID NO: 34366 - protein, 250 aa, Staphylococcus aureus; identical to SEQ ID NO: 31910
  subsp. aureus 21232

SEQ ID NO: 34367 - protein, 96 aa, Staphylococcus aureus; identical to SEQ ID NO: 30813
  subsp. aureus 21232

SEQ ID NO: 34368 - protein, 274 aa, Staphylococcus aureus; identical to SEQ ID NO: 30872
  subsp. aureus 21232

SEQ ID NO: 34369 - protein, 338 aa, Staphylococcus aureus; identical to SEQ ID NO: 30699
  subsp. aureus 21232

SEQ ID NO: 34370 - protein, 351 aa, Staphylococcus aureus; identical to SEQ ID NO: 30720
  subsp. aureus 21232

SEQ ID NO: 34371 - protein, 149 aa, Staphylococcus aureus
  subsp. aureus 21232
DSDSDSDSDSDSDSDSDSDSDSDSDSDSDSDSDSDSDSDSDSDSDSGSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34372 - protein, 2186 aa, Staphylococcus aureus
  subsp. aureus 21232
MNLLKKNKYSIRKYKVGIFSTLIGTVLLLSNPNGAQPLTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 34373 - protein, 233 aa, Staphylococcus aureus; identical to SEQ ID NO: 30428
  subsp. aureus 21232

SEQ ID NO: 34374 - protein, 139 aa, Staphylococcus aureus
  subsp. aureus 21232
DSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 34375 - protein, 807 aa, Staphylococcus aureus
  subsp. aureus 21232
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTYTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34376 - protein, 141 aa, Staphylococcus aureus; identical to SEQ ID NO: 30715
  subsp. aureus 21232

SEQ ID NO: 34377 - protein, 231 aa, Staphylococcus aureus; identical to SEQ ID NO: 31073
  subsp. aureus 21232

SEQ ID NO: 34378 - protein, 2476 aa, Staphylococcus aureus
  subsp. aureus 21232
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 34379 - protein, 241 aa, Staphylococcus aureus; identical to SEQ ID NO: 30776
  subsp. aureus 21232

SEQ ID NO: 34380 - protein, 508 aa, Staphylococcus aureus; identical to SEQ ID NO: 30777
  subsp. aureus 21232

SEQ ID NO: 34381 - protein, 465 aa, Staphylococcus aureus
  subsp. aureus 21232
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITT

SEQ ID NO: 34382 - protein, 917 aa, Staphylococcus aureus; identical to SEQ ID NO: 31037
  subsp. aureus 21232

SEQ ID NO: 34383 - protein, 85 aa, Staphylococcus aureus
  subsp. aureus 21232
KPVPPAKEEPKKPSKPVEQGKVVTPVIEINEKVKAVAPTKKPQSKKSELPETGGEESTNKGMLFGGLFSILGLALLRRNKKNHKA

SEQ ID NO: 34384 - protein, 327 aa, Staphylococcus aureus; identical to SEQ ID NO: 30538
  subsp. aureus 21232

SEQ ID NO: 34385 - protein, 311 aa, Staphylococcus aureus; identical to SEQ ID NO: 30617
  subsp. aureus 21232

SEQ ID NO: 34386 - protein, 287 aa, Staphylococcus aureus
  subsp. aureus 21232
LAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 34387 - protein, 325 aa, Staphylococcus aureus; identical to SEQ ID NO: 30407
  subsp. aureus 21232

SEQ ID NO: 34388 - protein, 315 aa, Staphylococcus aureus; identical to SEQ ID NO: 30440
  subsp. aureus 21232

SEQ ID NO: 34389 - protein, 321 aa, Staphylococcus aureus; identical to SEQ ID NO: 30959
  subsp. aureus 21232

SEQ ID NO: 34390 - protein, 327 aa, Staphylococcus aureus
  subsp. aureus 21235
MKMKKLVKSSVASSIALLLLSNTVDAAQHITPVSEKKVDDKITLYKTTATSDNDKLNISQILTFNFIKDKSYDKDTLVLKAAGNINSGYKKPNPRDYDYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLISTDSKETNPGV

SEQ ID NO: 34391 - protein, 306 aa, Staphylococcus aureus
  subsp. aureus 21235
MLAATLSVGLIAPLASPIHESRANTNIENIGDGAEVIKRTEDVSSKKWGVTQNVQFDFVKDKKYNKDALIVKMQGFINSRTSFSDVKGSGYELTKRMIWPFQYNIGLSTKDPYVSLINYLPKNKIETTDVGQTLGYNIGGNFQSAPSIGGNGSFNYSKTISYTQKSYVSEVDKQNSKSVKWGVKANEFVTPDGKKSAQDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 34392 - protein, 467 aa, Staphylococcus aureus
  subsp. aureus 21235
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKPGKEDNNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34393 - protein, 259 aa, Staphylococcus aureus; identical to SEQ ID NO: 30655
  subsp. aureus 21235

SEQ ID NO: 34394 - protein, 331 aa, Staphylococcus aureus
  subsp. aureus 21235
MSNQFKSEEERRQWEQFQAFQNQQNQQYQQYGQKKSKKGWFWGCGGCLVLFILIIIGISACTAGITGNLGGNSSKEANKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVTVASSNSDNVNYEASATTPATTSSADTDSEDSEKSSKDEDKQNASKSDKSSVEKSESNEETAPVEPMPHSKPTTSEAPPSQNIHNEDSMYDASTE

SEQ ID NO: 34395 - protein, 324 aa, Staphylococcus aureus
  subsp. aureus 21235
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNGYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIV

SEQ ID NO: 34396 - protein, 92 aa, Staphylococcus aureus
  subsp. aureus 21235
MSTSQTHFTSTSISTSESIAPNTNESQSTLSATSVSSKHDAEPAQSEERLPDTGDSIKQNGLLGGVMTLLVGLGLMKRKKKKDENDQDDSQA

SEQ ID NO: 34397 - protein, 154 aa, Staphylococcus aureus
  subsp. aureus 21235
MKLKTLAKATLALGLLTTGVITSEGQAVQAKEKQERVQHLYDIKDLYRYYSSESFEFSNISGKVENYNGSNVVRFNQKGQNHQLFLLGKDKEEYKEGIEGKDVFVVKELIDPNGRLSTVGGVTKKNNQSSETNIHLLVNKLDGGNLDATNDSFL

SEQ ID NO: 34398 - protein, 234 aa, Staphylococcus aureus; identical to SEQ ID NO: 33552
  subsp. aureus 21235

SEQ ID NO: 34399 - protein, 347 aa, Staphylococcus aureus
  subsp. aureus 21235
MKITTIAKTSLALGLLTTGVITTTTQAASATTPSSTKVETPQQAANATTPSSTKVEAPKQTPNATTPSSTKVETPQQTPNATTPSSTKVEAPQQATNATTPSSTKVEKPQQAANATTPSSTKVEAPQQTPNATTPSSTKVETPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLVENHNLYGNVGSGKIVIKMKNGGKYTFELHKKLQENRMADVIDGTNIDNIEVNIK

SEQ ID NO: 34400 - protein, 369 aa, Staphylococcus aureus
  subsp. aureus 21235
MKMRTIAKTSLALGLLTTGAITVTTQSVKAEKVQSTKVDKVPTLKAERLAMINITTGANTATTQAANTRQERTPKLEKAPNTNEEKNSASKIEKISQPKQEAQKSLNISATQAPKQEQSQTITESTTQQTKVTTPPSTNTQQTKVTIPPSTNAPQPMQSTKSDTPQSPTIKQSQTDITPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHDLYGNMGSGTIVIKMKNGGKYTFELHKRLQEHRMADVIEGTNIDKIEVNIK

SEQ ID NO: 34401 - protein, 231 aa, Staphylococcus aureus
  subsp. aureus 21235
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 34402 - protein, 226 aa, Staphylococcus aureus
  subsp. aureus 21235
MKFKAIAKASLALGMLATGVITSNTQSVQAKTEVKQQSESELKHYYNKPFFERKNVTGYKYTENGKDYMEVATDHQYYQISLLGPDKDKFKEGNNPGLDIFVVREGDSRQAANYSIGGVTKTNSQPFIDYIHTPILEIKKGNEDAQTIYYQIYKEDISLKELDFKLRKQLISQSGLYSNGLKQGQITITMNDGTTHTIDLSQKLEKERMGESIDGTKINKILVEIK

SEQ ID NO: 34403 - protein, 203 aa, Staphylococcus aureus
  subsp. aureus 21235
MFKKYDSKNSIVLKSILSLGIIYGGTFGIYPKADALTQNSSSVQDKQLQKVEEVPNNSEKALVKKLYDRYSKNSINGKSNKSRNWVYSERPLNENQVRIHLEGTYTVAGRVYTPKRNITLNKEVVTLKELDHIIRFAHISYGLYMGEHLPKGNIVINTKDGGKYTLESHKELQKNRENVEINTDDIKNVTFELVKSVNDIEQV

SEQ ID NO: 34404 - protein, 808 aa, Staphylococcus aureus
  subsp. aureus 21235
MTYKMKKWQKLSTITLLMAGVITLNGGEFRSIDKHQIAVADTNVQTPDYEKLRNTWLNVNYGYNQYDENNDAMKKKFVATENEAEKLLKEMKTESGKTYLWDSAKDLDTKSADMTRTYRNIEKIAEAMKHKNTKLNTPDNKNKVKDALEWLHENAYGKEPTEKVKELSENFTKTTGKNTNLNWWDYEIGTPRALTNTLILLNDQFSNEEKKKYTAPIKTFAPDSDKILSSVGQPEQAKGGNLVDIAKVKLLESIIEEDTTMMKESIDAFNKVFTYVQSNATGKERNGFYKDGSYIDHKDVPYTGAYGVVLLEGISQMMPMIKETPFKDSNQNDTTLKSWIDDGFMPLIYKGEMMDLSRGRAISRENETSHSASATVMKSLLRLSDAMDESTKAKYKQIVKTSVKSDSTYKQNDYLSSYSDISKMKSLMEDSTISTNGLTQQLKIYNDMDRVTYHNKYLDFAFGLSMTSKNVARYESINNENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKDPVTTIENRKANGYTLYTDDKQTTNSDNQGTNSVFLESTNSTQNNIDYHFLNKSKITVKKESHTGKWSEINKSQKSDDRKDEYYEVTQKHSNTDSKYAYVLYPGISKDVFKSKASQVTVVKQDDDFHVVKDNDSVWAGVNYSDSTQTFDINGTKVEVKAKGMFILKKKDDNTYECSFYNPESTNSASDIESKISVTGYTITNKNTSTSNESGVHFELTK

SEQ ID NO: 34405 - protein, 141 aa, Staphylococcus aureus
  subsp. aureus 21235
MKLKSFVTATLALGLLSSVGAALPSHEASADSNNGYKEMTMDGYHTIPYTISVDGITALHRTYFVFPENKKVLYQEIDSKVKNELASQRGVTTEKINNAQTATYTLTLNDGNKKVVNLKKNDDAKNSIDPSTIKQIQIVVK

SEQ ID NO: 34406 - protein, 241 aa, Staphylococcus aureus; identical to SEQ ID NO: 30608
  subsp. aureus 21235

SEQ ID NO: 34407 - protein, 241 aa, Staphylococcus aureus
  subsp. aureus 21235
MNNNITKKIILSITLLLLGTASTQFPNTPISSSTEAKAYYINQNETNVNELTKYYSQKHLTFSNKTLWQKDNGTIHATLLQFSWYSHIQVYGPESWGNINQLRNKNVDIFGIKDQETIDSFALSQETFTGGVTPAATSNDKHYKLNVTYKDKAETFTGGFPVYEGNKPVLTLKELDFPIRQTLIKSKKLYNNSYNKGQIKITGADNNYTIDLSKRLPSTDANRYVKKPQNAKIEVILEKSN

SEQ ID NO: 34408 - protein, 238 aa, Staphylococcus aureus
  subsp. aureus 21235
MNKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPILTLKEIDFRAQEALIKNKILYNENRNKGKLKITGGGNNYTIDLSKRLHSDLANVYVKNPNKITVAVLFD

SEQ ID NO: 34409 - protein, 319 aa, Staphylococcus aureus; identical to SEQ ID NO: 30495
  subsp. aureus 21235

SEQ ID NO: 34410 - protein, 165 aa, Staphylococcus aureus; identical to SEQ ID NO: 31315
  subsp. aureus 21235

SEQ ID NO: 34411 - protein, 354 aa, Staphylococcus aureus
  subsp. aureus 21235
MTKHYLNSKYQSEQRSSAMKKITMGTASIILGSLVYIGADSKQVNAATEATNATNNQSAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKAENTQTTKVVSTEATKDQSQTQSARTVKTTQTAQEQNKVQTPVKDVATAKSESNNQAVSDNKSQQTNKVTKQNEVHKQASSKDSKAKELPKTGLTSVDNFISTVAFATLALLGSLSLLLFKRKESK

SEQ ID NO: 34412 - protein, 645 aa, Staphylococcus aureus
  subsp. aureus 21235
MNKQQKEFKSFYSIRKSSLGVASVAISTLLLLMSNGEAKAAEETGGTNTEAQPKTEAVASPTTTTTEKAPEAKPVANAVSVSNKEVVAPTTETKEAKEVKEVKAPKETKEVKPAAKADNNTYPILNKELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYIEGKTLYDAIVKVHVKTIDYDGQYHVRIVDKEAFTKANADKSNKKEQQDNSAKKETTPATPSKPTTPPVEKESQKQDSQKDDNTQSPSVEKENDASSESGKDKTPATKPAKGEVESSSTTPTKVVSTTQNVAKPTTASSETTKDVVQTSAGPSEAKDSAPLQKANIKNTNDGHTQSQNNKNTQEDKAKSLPQTGEESNKDMTLPLMALLALSSIVAFVLPRKRKN

SEQ ID NO: 34413 - protein, 211 aa, Staphylococcus aureus
  subsp. aureus 21235
MKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTTNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 34414 - protein, 927 aa, Staphylococcus aureus
  subsp. aureus 21235
MIVVGMGQEKEAAASEQNNTTVEESGSSATERKASETQTTTNNVNTIDETQSYSATSTEQPSQSTQVTIEEAPTTVQAPKVETSRVDLPSEKVADKKTTGTQVDTTQPSNVSEIKPRMKRSTDVAAVAEKEVVEEAKATGTDVTSKVTVEEGSEIVGHNNKETNVVNPHNAERVTLKYKWNFGEGIKAGDYFDFTLSDNVETHGISTLRKVPEIKSSTEDKVMANGQVIGERKIRYTFTDYIDNKKDLTAELTLNLFIDPTTVTKQGMEKVEVSLGQNKVSKEFDIKYLDGVKDRMGVTVNGRIDTLNKADGKFSHFAYVKPNNQSLSSVTVTGQVTSGYKQNAKNPTVKVYKHIGSDELAESVYAKLDDANKFEDVTNKVNLSYTGDGGYSLNFNDLDNTKNYVIKYEGEYDQNAKDLNFRTHLSGYHKNYLYSPYYPYYPVQLTWNNGVAFYSNNAQGDGKDKPNDPIIEKSEPIDLDIKSEPPVEKHELTGTIEESSDSKPIDFEYHTAVEGAEGHAEGIVETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPSEPGKPTPPTPEVPSEPGTPVPPTPEVPAEPGKPVPPAKEEPKKPSKPVEQGKVVTPVIEINEKVKAVAPTKQKQSKKPELPETGGEESTNKGMLFGGLFSILGLALLRRNKKNHKA

SEQ ID NO: 34415 - protein, 233 aa, Staphylococcus aureus; identical to SEQ ID NO: 30678
  subsp. aureus 21235

SEQ ID NO: 34416 - protein, 699 aa, Staphylococcus aureus
  subsp. aureus 21235
MAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETFVSTLTGYKFNPDAKNFKIYEVTDQNQFVDSFTPDTSKLKDVTNQFNITYSNDNKTATVDLMNGQTSSNKQYIIQQVAYPDNSSTDNGKIDYTLETQNGKSSWSNSYSSVNGSSTANGDQKKYNLGDYVWEDTNKDGKQDTNEKGIKGVYVILKDSNGKELDRTTTDENGKYQFTGLGNGTYSVEFSTPAGYTPTTANSGTDDAVDSDGLTTTGVIKDADNMTLDSGFYKTPKYSLGDYVWYDSNKDGKQDSTEKGIKDVKVTLLNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSGSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34417 - protein, 121 aa, Staphylococcus aureus
  subsp. aureus 21235
MNNKKTATNRKGMIPNRLNKFSIRKYSVGTASILVGTTLIFGLSGHEAKAAEHTNGELNQSKNETTAPSENKTTEKVDRRQQNNIEQSTTSNQPKVNESDNTSVKETTEEPQNTTSTQPTK

SEQ ID NO: 34418 - protein, 227 aa, Staphylococcus aureus
  subsp. aureus 21235
MKFTALAKATLALGILTTGTLTTEAHSSHAKQNQESVNKHDKEALYRYYTGKTMELKNINALKHGKNNLRFKYRGMKIQVLLLGNDKNRFQHRSYKGLDVFFVQEKRDKHDIFYTVSGVIQTNKTSGVVSAPILNVTNEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 34419 - protein, 103 aa, Staphylococcus aureus
  subsp. aureus 21235
MFGFVSNPSLQVKKVDAKNGFSINELFFIQKEEVSVKELDFKIRKLLIEKYRLYKGTADKGRIVINMKDEKKHEIDLSGKLSFERMFDVMDSKKIKNIEVNLN

SEQ ID NO: 34420 - protein, 232 aa, Staphylococcus aureus
  subsp. aureus 21235
MKFTAIAKAIFVLGILTTSVMITENQSVNAKGKYEKMNRLYDTNKVHQYYSGPSYELTNVSGQSQSYYDSNVLLFNQQNQKFQVFLLGKDENKYKEKTHGLDVFAVPELVDLDGRIFSVSGVTKKNVKSIFESLRTPNLLVKKIDDKGGFSIDEFFFIQKEEVSLKELDFKIRKLLIKKYKLYEGSADKGRIVINMKDENKYEIDLSDKLDFERMADVISSKQIKNIEVNLK

SEQ ID NO: 34421 - protein, 76 aa, Staphylococcus aureus
  subsp. aureus 21235
NKEEVSLKELDFKIRKQLVEKYGLYQGTSKYGKITIILNDGKKEVIDLGDKLQFERMGDVLNSKDINKIEVTLKQI

SEQ ID NO: 34422 - protein, 372 aa, Staphylococcus aureus; identical to SEQ ID NO: 31139
  subsp. aureus 21235

SEQ ID NO: 34423 - protein, 338 aa, Staphylococcus aureus
  subsp. aureus 21235
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 34424 - protein, 274 aa, Staphylococcus aureus
  subsp. aureus 21235
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYNK

SEQ ID NO: 34425 - protein, 321 aa, Staphylococcus aureus; identical to SEQ ID NO: 30959
  subsp. aureus 21235

SEQ ID NO: 34426 - protein, 315 aa, Staphylococcus aureus
  subsp. aureus 21235
MLKNKILATTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIALKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 34427 - protein, 325 aa, Staphylococcus aureus; identical to SEQ ID NO: 30407
  subsp. aureus 21235

SEQ ID NO: 34428 - protein, 182 aa, Staphylococcus aureus
  subsp. aureus 21235
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNNDVVSNNTTLNVPNRTNENGSGGHLTLKEIQEDVRHSSDKPELVAIAE

SEQ ID NO: 34429 - protein, 839 aa, Staphylococcus aureus
  subsp. aureus 21235
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNGQVTASDFKLEKTAFDPNQSGNIFMAANFKVAGKVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVNPKDPTPGPPVDPEPSPEPEPEPTPDPEPSPEPDPDSDSDSDSGSDSDSDSDSDSDSDSESDSDSDSDSDSESDSDSESDSDSDSDSDSDSDSDSDSDSDSDSDSDSDSDLDSDSDSDSESDSDSDSDSDSDSDSDSDSDSDSDSDSDSDSDSDSDSDSDSDLDSDSDSDSDSDSDSDSDSDSDSDSDSDSDSDSDSESDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 34430 - protein, 54 aa, Staphylococcus aureus
  subsp. aureus 21235
MDAQKAVNLFKRTRTVATHRKAQRAVNLIHFQHSYEKKKLQRQIDLVLKYNTLK

SEQ ID NO: 34431 - protein, 242 aa, Staphylococcus aureus
  subsp. aureus 21235
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFIYDLFYTGTGQAESFLKIYDDNKTIDTENFHLDVEISYEKTE

SEQ ID NO: 34432 - protein, 242 aa, Staphylococcus aureus; identical to SEQ ID NO: 30536
  subsp. aureus 21235

SEQ ID NO: 34433 - protein, 1031 aa, Staphylococcus aureus
  subsp. aureus 21235
MNMKKKEKHAIRKKSIGVASVLVGTLIGFGLLSSKEADASENSVTQSDSASNESKSSDSSSVNAAPKTDNTNVSDTKTTSNTNNGETSVAQNPAQQETTQSASTNATTEETPVTGEATTTATNQANTPATTQSSNTNAEELVNQTSNETTSNDTNNVSSVNSPQNSTNAENVSTTQDTSTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSDSASDSGSASDSDSASYSDSASYSDSASDSDSASDSDSASDSDSASDSDSASDSDSASDSDSASDSDSASDSDSASDSDSASDSDSASDSDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDLDSDSDSDSDSDSDSDSESDSDSDSDSDSDSASDSDSGSDSDSSSDSDSGSASDSDSDSDSANDSDSDSDSDSASDSDSGSASDSDSDSDSASDSDSGSDSDSASDSDSDSDSDSDSDSDSASDSDSNSDSDSDSDSDSDSDSDSDSDSDSASDSDSDSTSDTGSDNDSDSESDSNSDSDSGSNNNVVPPNSPKNGTNASNKNEAKDSKEPLPDTGSEGEANTSLIWGLLASLGSLLLFRRKKENKDKK

SEQ ID NO: 34434 - protein, 434 aa, Staphylococcus aureus [sequence omitted]

SEQ ID NO: 34435 - protein, 1529 aa, Staphylococcus aureus
  subsp. aureus 21235
MNYRDKIQKFSIRKYTVGTFSTVIATLVFLGFNTSQAHAAETNQPASVVKQKQQSNNEQTENRESQAQNSQNSQNGQSLSATHENEQPNISQANLVDQKVAQSTTTNDEQPASQNVNTKKDSATAATTQPDKEEIKHKQNESQSANKNGNDSRAAHVENHEANVVTASDSSDNGNVQHDRNELQAFFDANYHDYRFIDRENTDSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPDRSHDFKIRNRSGQVIYSWPTVHVYSLEDLSRASDYFSEAGATAATKAFGRQNFEYINGQKPAESPGVPKVYTFIGQGDASYTISFRTQGPTTNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYPTNATTNAFRPGGVQELNEYQLSQLFTDQKLQEAARTRSPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTIITTAEQLRGTALQKVPVNISGIPLDPSALVYLVAPTNQTTNGGSEADQIPSGYTILATGTPDGVHNTITIQPKDYVVFIPPVGKQIRAVVYYNKVVASNMSNAVTILPDDIPPTINNPVGINAKYYRGDEVSFTMGVSDRHSGLKSTTITTLPSGWTSNLTKSDNKNGSLSITGRVSMNQAFNSDITFKVSATDNVNNTTNDSQSKHVSIHVGKISEDAHPIVLGNTEKVVVVNPTAVSNDEKQNIITAFMNKNQNIRGYLASTDPITVDNNGNVTLHYRDGSSTTLDATNVMTYEPVVKSEYQTANAAKTATVTIAKGQSFNIGDIKQYFTLSNGQAIPSGTFTNIKSDRTIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFTQDYTVTWTNAKIANRPTDGGLSWSDDHKSLIYRYDATLGTQITTNDILTMLKATTTVPGLRNNITGNEKAQAEAGGRPNYRTTGYSQANASSDGQRQYTLNGQVIQILDIINPSNGYGGQPVTNSNTRANHSNATVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPTTS

SEQ ID NO: 34436 - protein, 250 aa, Staphylococcus aureus
  subsp. aureus 21235
MGEFEVKYLTGFILILLLEGILTNSASAIEYSDLHHKSKLDSKRLYNAKVSFANPTQLENKKTNDRLLKHDLLFHDMFVNDAWKKDFKVEFENEALSKKFINKDIDIFAGNYGYGCHGGATNKTQCSYGGVTLSNNNKYDDYKNIPCNLWIDGHQTEIELTAVKTKKKIVTIQELDVQLRNYLNKKYKLYEQGGDIVKGYVKYHNDDEKNVEYDFYNLNGEYGHEVLKMYADNKTINSDKLHLDIYLFKS

SEQ ID NO: 34437 - protein, 291 aa, Staphylococcus aureus; identical to SEQ ID NO: 30390
  subsp. aureus 21235

SEQ ID NO: 34438 - protein, 227 aa, Staphylococcus aureus; identical to SEQ ID NO: 30586
  subsp. aureus 21235

SEQ ID NO: 34439 - protein, 809 aa, Staphylococcus aureus
  subsp. aureus 21235
MNKNVLKFMVFIMLLNIITPLFNKNDALAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSNYYSGPNAITDFEKAFPGSKITVDNTKNTIDVTIPQGYGSYNSFSINYKTKITNEQQKEFVNNSQAWYQEHGKEEVNGKSFNHTVHNINANAGIEGTVKGKLKVLKQDKDTKAPIANVKFKLSKKDGSVVKDNQKEIEIITDANGIANIKALPSGDYILKEIEAPAPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKTVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPNKPDHSNKVKPTPPDEPSKVDKVDQPKDNKTKPENPLKELPKTGMKIITSWITWVFIGILGLYLILRKRFNS

SEQ ID NO: 34440 - protein, 681 aa, Staphylococcus aureus
  subsp. aureus 21235
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEALPLNKSNQTSQREIVNKSEIEKVQPQQNNQANDKITNYNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAVHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQFNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34441 - protein, 237 aa, Staphylococcus aureus
  subsp. aureus 21235
MNKHQPKLRSFYSIRKSTLGVASVIVSTLFLITSQHQAQAAENTNTSDKISENQNNNATTTQPPKDTNQTQPATQPANTAKNYPAADESLKDAIKNPAVENKEHDIGPREQVNFQLLDKNNETQYYHFFSIKDPADIYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDA

SEQ ID NO: 34442 - protein, 234 aa, Staphylococcus aureus
  subsp. aureus 21235
MNKKLLMNFFIVSPLLLATIATDFTPVPLSSNQIIKTAKASTNDNIKDLLDWYSSGSDTFTNSEVLDISLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 34443 - protein, 2485 aa, Staphylococcus aureus
  subsp. aureus 21235
MNLFRQQKFSIRKFNVGIFSALIATVTFISTNPTTASAAEQNQPAQNQPAQPADANAQPNANAGAQANPTAQPAASANQGQPAAQPANQGGQANPAGGAAQPNTQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALDRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLDQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKTQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNGIAAINQVQAATTKKSDAKAEIAQKASERKTAIEAMNDSTTEEQQAAKDKVDQAVVTANADIDNAAANADVDNAKTTSEATIAAITPDANVKPTAKQAIADKVQAQETAIDANNGATTEEKQAAKQQVQTEKTTADTAIDGAHSNAEVEAAKNAEIAKIEAIQPATTTKDDAKQAITTKANERKTAIAQTQDITAEEIAAANADVDNAVTQANSNIEAANSQNDVDQAKTTGEASIDQVTPTVNKKATARNEITTILNNKLQAIQATPDATTEEKQAADAEANTENGKAIQAIAAATTNADVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADVQGITADTTIKDVAKDELATKANEQKALIAQTADATTEEKEQANQQVDAQLTQGNQNIENAQSIDDVNTAKDNAIQAIDSIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIEAAYNSKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQVIDAKAEETKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNANADTSSTTTNNQNDAATGETTATSANSSATDDANDKPQANNNSSADTSTNSPTMDNDVTSKPEVESTNNGTTDKPATEADNATLAESATNNNSTTTATNENAPTESTATAPTTASTGAESSADSKDNASVNDSKQNAEVNNSAESQSTNGKVAQPKSENKAKAEKDGRDSTNQSMVESTTETLPSADITEPKVSSNTSKDKEESTTNQTDAEQHNSDTNVASNEADKSEGNVDTDVSNKPSTSKPSEAKDKMTSTNVSQTDDTATADTNDTQKSVGSAANIKAKDMQTNDMKASLATVSKGSNSANQDMLNVTKTKENKTNAKSAQQGKVNKPKQQAKTLPDTGMSHNDDLPYAELALGAGMAFLIRRFTKKDQQTEE

SEQ ID NO: 34444 - protein, 231 aa, Staphylococcus aureus
  subsp. aureus 21235
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSADHANQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 34445 - protein, 469 aa, Staphylococcus aureus
  subsp. aureus 21235
MKFKSLITTTLALGVLASTGANFNNNEASAAAKPLDKSSSSLHHGYSKVHVPYAITVNGTSQNILSNLTFNKNQNISYKDLEGKVKSVLESNRGITDVDLRLSKQAKYTVNFKNGTKKVIDLKAGIYTANLINSSDIKSININVDTKKHVENKAKRNYQVPYSINLNGTSTNILSNLSFSNKPWKNYKDLTSQIKSVLKHDRGISEQDLKYAKKAYYTVYFKNGGKRILQLNSKNYTANLVHAKDVKRIEITVKTGPKAKADRYVPYTIAVNGTSTPILSKLKLSQKELISYKYLNDKVKSVLKSERGISDLDLKFVKQAKYTVHFKNGKKQVVNLKSDIFTPNLFSAKDIKKIDIDVKQHTKSKKKINKSNNVKFPVTINKFENLVSNEFVFYNASKITINDLSIKLKSAMANDQGITKHDIGLAERAVYKVYFKNGSSKYVDLKTEYKDGKVFKATDIKKVDIELKF

SEQ ID NO: 34446 - protein, 989 aa, Staphylococcus aureus; identical to SEQ ID NO: 31697
  subsp. aureus 21236

SEQ ID NO: 34447 - protein, 239 aa, Staphylococcus aureus; identical to SEQ ID NO: 32520
  subsp. aureus 21236

SEQ ID NO: 34448 - protein, 254 aa, Staphylococcus aureus; identical to SEQ ID NO: 30809
  subsp. aureus 21236

SEQ ID NO: 34449 - protein, 131 aa, Staphylococcus aureus; identical to SEQ ID NO: 30867
  subsp. aureus 21236

SEQ ID NO: 34450 - protein, 259 aa, Staphylococcus aureus; identical to SEQ ID NO: 30226
  subsp. aureus 21236

SEQ ID NO: 34451 - protein, 351 aa, Staphylococcus aureus; identical to SEQ ID NO: 30628
  subsp. aureus 21236

SEQ ID NO: 34452 - protein, 338 aa, Staphylococcus aureus; identical to SEQ ID NO: 30627
  subsp. aureus 21236

SEQ ID NO: 34453 - protein, 165 aa, Staphylococcus aureus; identical to SEQ ID NO: 30805
  subsp. aureus 21236

SEQ ID NO: 34454 - protein, 274 aa, Staphylococcus aureus; identical to SEQ ID NO: 30872
  subsp. aureus 21236

SEQ ID NO: 34455 - protein, 242 aa, Staphylococcus aureus; identical to SEQ ID NO: 30399
  subsp. aureus 21236

SEQ ID NO: 34456 - protein, 258 aa, Staphylococcus aureus; identical to SEQ ID NO: 30410
  subsp. aureus 21236

SEQ ID NO: 34457 - protein, 62 aa, Staphylococcus aureus; identical to SEQ ID NO: 30610
  subsp. aureus 21236

SEQ ID NO: 34458 - protein, 372 aa, Staphylococcus aureus; identical to SEQ ID NO: 30609
  subsp. aureus 21236

SEQ ID NO: 34459 - protein, 319 aa, Staphylococcus aureus; identical to SEQ ID NO: 30605
  subsp. aureus 21236

SEQ ID NO: 34460 - protein, 241 aa, Staphylococcus aureus; identical to SEQ ID NO: 30608
  subsp. aureus 21236

SEQ ID NO: 34461 - protein, 434 aa, Staphylococcus aureus [sequence omitted]

SEQ ID NO: 34462 - protein, 327 aa, Staphylococcus aureus; identical to SEQ ID NO: 30616
  subsp. aureus 21236

SEQ ID NO: 34463 - protein, 325 aa, Staphylococcus aureus; identical to SEQ ID NO: 30407
  subsp. aureus 21236

SEQ ID NO: 34464 - protein, 949 aa, Staphylococcus aureus
  subsp. aureus 21236
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 34465 - protein, 311 aa, Staphylococcus aureus; identical to SEQ ID NO: 30617
  subsp. aureus 21236

SEQ ID NO: 34466 - protein, 268 aa, Staphylococcus aureus; identical to SEQ ID NO: 30398
  subsp. aureus 21236

SEQ ID NO: 34467 - protein, 179 aa, Staphylococcus aureus; identical to SEQ ID NO: 30225
  subsp. aureus 21236

SEQ ID NO: 34468 - protein, 138 aa, Staphylococcus aureus; identical to SEQ ID NO: 30785
  subsp. aureus 21236

SEQ ID NO: 34469 - protein, 227 aa, Staphylococcus aureus; identical to SEQ ID NO: 30586
  subsp. aureus 21236

SEQ ID NO: 34470 - protein, 1194 aa, Staphylococcus aureus
  subsp. aureus 21236
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDS

SEQ ID NO: 34471 - protein, 238 aa, Staphylococcus aureus; identical to SEQ ID NO: 30606
  subsp. aureus 21236

SEQ ID NO: 34472 - protein, 241 aa, Staphylococcus aureus; identical to SEQ ID NO: 30607
  subsp. aureus 21236

SEQ ID NO: 34473 - protein, 877 aa, Staphylococcus aureus; identical to SEQ ID NO: 30593
  subsp. aureus 21236

SEQ ID NO: 34474 - protein, 241 aa, Staphylococcus aureus; identical to SEQ ID NO: 30571
  subsp. aureus 21236

SEQ ID NO: 34475 - protein, 500 aa, Staphylococcus aureus
  subsp. aureus 21236
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34476 - protein, 173 aa, Staphylococcus aureus
  subsp. aureus 21236
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34477 - protein, 36 aa, Staphylococcus aureus
  subsp. aureus 21236
PETGGEESTNKGMLFGGLFSILGLALLRRNKKNNKA

SEQ ID NO: 34478 - protein, 982 aa, Staphylococcus aureus
  subsp. aureus 21236
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDS

SEQ ID NO: 34479 - protein, 109 aa, Staphylococcus aureus; identical to SEQ ID NO: 30603
  subsp. aureus 21236

SEQ ID NO: 34480 - protein, 350 aa, Staphylococcus aureus; identical to SEQ ID NO: 30602
  subsp. aureus 21236

SEQ ID NO: 34481 - protein, 321 aa, Staphylococcus aureus; identical to SEQ ID NO: 30959
  subsp. aureus 21236

SEQ ID NO: 34482 - protein, 241 aa, Staphylococcus aureus; identical to SEQ ID NO: 32458
  subsp. aureus 21236

SEQ ID NO: 34483 - protein, 315 aa, Staphylococcus aureus; identical to SEQ ID NO: 30573
  subsp. aureus 21236

SEQ ID NO: 34484 - protein, 464 aa, Staphylococcus aureus
  subsp. aureus 21236
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTIT

SEQ ID NO: 34485 - protein, 233 aa, Staphylococcus aureus; identical to SEQ ID NO: 30591
  subsp. aureus 21236

SEQ ID NO: 34486 - protein, 96 aa, Staphylococcus aureus; identical to SEQ ID NO: 30813
  subsp. aureus 21236

SEQ ID NO: 34487 - protein, 231 aa, Staphylococcus aureus; identical to SEQ ID NO: 30630
  subsp. aureus 21236

SEQ ID NO: 34488 - protein, 232 aa, Staphylococcus aureus; identical to SEQ ID NO: 30583
  subsp. aureus 21236

SEQ ID NO: 34489 - protein, 2186 aa, Staphylococcus aureus; identical to SEQ ID NO: 30516
  subsp. aureus 21236

SEQ ID NO: 34490 - protein, 232 aa, Staphylococcus aureus; identical to SEQ ID NO: 30584
  subsp. aureus 21236

SEQ ID NO: 34491 - protein, 356 aa, Staphylococcus aureus; identical to SEQ ID NO: 30793
  subsp. aureus 21236

SEQ ID NO: 34492 - protein, 891 aa, Staphylococcus aureus; identical to SEQ ID NO: 30788
  subsp. aureus 21236

SEQ ID NO: 34493 - protein, 36 aa, Staphylococcus aureus
  subsp. aureus 21236
PETGGEESTNKGMLFGGLFSILGLVLLRRNKKNNKA

SEQ ID NO: 34494 - protein, 681 aa, Staphylococcus aureus; identical to SEQ ID NO: 30598
  subsp. aureus 21236

SEQ ID NO: 34495 - protein, 211 aa, Staphylococcus aureus; identical to SEQ ID NO: 30592
  subsp. aureus 21236

SEQ ID NO: 34496 - protein, 291 aa, Staphylococcus aureus; identical to SEQ ID NO: 30390
  subsp. aureus 21236

SEQ ID NO: 34497 - protein, 2037 aa, Staphylococcus aureus; identical to SEQ ID NO: 32526
  subsp. aureus 21236

SEQ ID NO: 34498 - protein, 141 aa, Staphylococcus aureus; identical to SEQ ID NO: 30633
  subsp. aureus 21236

SEQ ID NO: 34499 - protein, 809 aa, Staphylococcus aureus; identical to SEQ ID NO: 30632
  subsp. aureus 21236

SEQ ID NO: 34500 - protein, 331 aa, Staphylococcus aureus; identical to SEQ ID NO: 30615
  subsp. aureus 21236

SEQ ID NO: 34501 - protein, 292 aa, Staphylococcus aureus; identical to SEQ ID NO: 30580
  subsp. aureus 21236

SEQ ID NO: 34502 - protein, 165 aa, Staphylococcus aureus; identical to SEQ ID NO: 30418
  subsp. aureus 21236

SEQ ID NO: 34503 - protein, 153 aa, Staphylococcus aureus
  subsp. aureus 21236
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34504 - protein, 226 aa, Staphylococcus aureus; identical to SEQ ID NO: 30577
  subsp. aureus 21236

SEQ ID NO: 34505 - protein, 231 aa, Staphylococcus aureus; identical to SEQ ID NO: 30582
  subsp. aureus 21236

SEQ ID NO: 34506 - protein, 645 aa, Staphylococcus aureus; identical to SEQ ID NO: 30601
  subsp. aureus 21236

SEQ ID NO: 34507 - protein, 231 aa, Staphylococcus aureus; identical to SEQ ID NO: 30578
  subsp. aureus 21236

SEQ ID NO: 34508 - protein, 691 aa, Staphylococcus aureus; identical to SEQ ID NO: 30511
  subsp. aureus 21236

SEQ ID NO: 34509 - protein, 234 aa, Staphylococcus aureus; identical to SEQ ID NO: 30581
  subsp. aureus 21236

SEQ ID NO: 34510 - protein, 2481 aa, Staphylococcus aureus; identical to SEQ ID NO: 31413
  subsp. aureus 21236

SEQ ID NO: 34511 - protein, 203 aa, Staphylococcus aureus; identical to SEQ ID NO: 32530
  subsp. aureus 21236

SEQ ID NO: 34512 - protein, 227 aa, Staphylococcus aureus; identical to SEQ ID NO: 30585
  subsp. aureus 21236

SEQ ID NO: 34513 - protein, 175 aa, Staphylococcus aureus
  subsp. aureus 21252
KTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNDPVHSMDKNDKVKKSKIAKESVANQEKKRAELPKTGVESTQKGLIFSSIIGIAGLILLARRRKN

SEQ ID NO: 34514 - protein, 250 aa, Staphylococcus aureus
  subsp. aureus 21252
MGELEVKYLTGFILILLLEGIFTNSASAIEYSDLHHKSKLDSKRLYNAKVSFANPTDLENKKTNDRLLKHDLLFHDMFVNDDWKKDFKVEFENEALSKKFINKDIDIFAGNYGYGCHGGETNKTQCSYGGVTLSDNNKYDNDKNIPCNLWIDGHQTEIELTAVKTKKKIVTIQELDVQLRNYLNEKYKLYEQGGDIVKGYVKYHNDDEKNVEYDFYNLNGEYGHEVLKMYADNKTINSDKLHLDIYLFKS

SEQ ID NO: 34515 - protein, 139 aa, Staphylococcus aureus
  subsp. aureus 21252
MNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVVNNNEPTKEIKIANLEAQKF

SEQ ID NO: 34516 - protein, 241 aa, Staphylococcus aureus
  subsp. aureus 21252
MKNNLTKKIILSIALTMIGTATSQSPHSPISMSSEAKAYNISENETNVNELTKYYTQRHLTFSNKWLWQKDNGTIHATLLQLSWFSHIQVFGPESWGNINQLRNKYVDIFALKDYETWHTYMLAQETFTGGVTPAAKPSDKHYKLNLTYKDKSGTFIGEHPFYTGNKPVLTLKEVDFRIRQTLIKNKKLYHGNYNKGHIKITGGSNNYTIDLSKRLKSTDANRYVKNPQTAHTEILLEKSS

SEQ ID NO: 34517 - protein, 238 aa, Staphylococcus aureus
  subsp. aureus 21252
MRKRIMKKLIFMTTLLLLGTTATQTPNSPLNVSTEAKAYYIDQNETNINELIKYYTQKPLTFSNRWLYQYDDGNIYVEFKRYSWSAHIRLWGAESWGNINQLRDRYVDVFGLKDEDTSQLWWVYRDTFTGGVTPAASSSDKPYSLFVQYKDKLQTIIGAHKMYQGDKPILTLKEIDFRAREALIKNKILYHENRNKGKLKITGGGNDYTIDLSKRLHSDLANVYVKNPQKITVEVLID

SEQ ID NO: 34518 - protein, 319 aa, Staphylococcus aureus
  subsp. aureus 21252
MKTRIVSSVTTTLLLGSILMNPVANAADSDINIKTGTTDIGSNTTVKTGDLVTYDIENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKATKQQTNIDVIYERVRDDYQLHWTSTNWKGTNTKDKWTDRSSERYKIDWEKEEMTN

SEQ ID NO: 34519 - protein, 165 aa, Staphylococcus aureus; identical to SEQ ID NO: 32831
  subsp. aureus 21252

SEQ ID NO: 34520 - protein, 105 aa, Staphylococcus aureus; identical to SEQ ID NO: 31317
  subsp. aureus 21252

SEQ ID NO: 34521 - protein, 350 aa, Staphylococcus aureus; identical to SEQ ID NO: 34237
  subsp. aureus 21252

SEQ ID NO: 34522 - protein, 641 aa, Staphylococcus aureus
  subsp. aureus 21252
MNKQQKEFKSFYSIRKSSLGVASVAISTLLLLMSNGEAKAAEETGGTNTEAQPKTEAVASPTTTTEKAPEAKPVANAVSVSNKEVKAPTSETKEVKEVKAPKEAKEEKPAAKADNNTYPILNEELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKTAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKSTTAPVEKESQKQDSQKDDNKQSPSVEKEIDASSESGKDKTPATKPAKGEVESSSTTPTKVVSATQNVAKPTSASSETTKGVVQTSAGSSEAKDNAPLQKANIKNTNDGHTQSQNNKNTQENKAKSLPQTGEESNKDMTLPLMALLALSSIIAFVLPRKRKN

SEQ ID NO: 34523 - protein, 241 aa, Staphylococcus aureus; identical to SEQ ID NO: 32842
  subsp. aureus 21252

SEQ ID NO: 34524 - protein, 484 aa, Staphylococcus aureus
  subsp. aureus 21252
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDNKKPGKEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 34525 - protein, 321 aa, Staphylococcus aureus; identical to SEQ ID NO: 31900
  subsp. aureus 21252

SEQ ID NO: 34526 - protein, 315 aa, Staphylococcus aureus
  subsp. aureus 21252
MLKNKILATTLSVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDPNVSLINYLPKNKIESTNVSQTLGYNIGGNFQSAPSLGGNGSFNYSKSISYTQQNYVSEVEQQNSKSVLWGVKANSFVTASGQKSAFDSDLFVGYKPHSKDPRDYFVPDSELPPLVQSGFNPSFIATVSHEKGSGDTSEFEITYGRNMDVTHAIKRSTHYGNSYLDGHRIHNAFKNRNYTVKYEVNWKTHEIKVKGQN

SEQ ID NO: 34527 - protein, 325 aa, Staphylococcus aureus; identical to SEQ ID NO: 32859
  subsp. aureus 21252

SEQ ID NO: 34528 - protein, 808 aa, Staphylococcus aureus
  subsp. aureus 21252
MTYKMKKWQKLSTITLLIAGVITLNNGEFRNVDKHQIAVANTNVQTSDYEKLKKTWLDVNYGYDQYDENNQDMKKKFDAKEKEAKKLLEDMKTDTNRTYLWDSAKDLDKKSADMTKTYRNIEKIAEAMRHKNTSLKTDENKLKITDAIKWLHHNVYGKDPDKKVADLTTNRKEKDSSKKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKARNGFYKDGSYIDHQDVPYTGAYGVVLLEGISQILPMIKETPFNDKTQNNTTLKSWIDEGFMPLIYKGEMMDLSRGRAISRENETSHTASATVMKSLLRLSDTMDDSTKTKYKQIVKTSVKSDSSYDSNDTLNSYSDIDKMKKLTDDKSISTNDLTHQLKIYNEMDRVTYHNKDLDFAFGLSMTSKNVARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTGSSKNPVTSVENRKANGYKLYKDDIEITTSDVNAQETHSVFLESNDTKKNIGYHFLDKPKITVKKESHTGKWSEINKSQKTDDKKDEYYEVTQTHNTSDSKYAYVLYPGLSKSDFKPKNNNVSIVKQDEDFHVIKDNDGVFAGVNYSDSTKSFDINGITVELKEKGMFVIKKKDDNTYECSFYNPTSTNSTSNIESKISVTGYTITNKSVTNSNDAGVNFELTK

SEQ ID NO: 34529 - protein, 908 aa, Staphylococcus aureus
  subsp. aureus 21252
MNNKKTAINRKGMIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNISGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDEDNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDLDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSD

SEQ ID NO: 34530 - protein, 734 aa, Staphylococcus aureus
  subsp. aureus 21252
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPDPEPSPDPDPDSDSDSDSDSGSDSDSDSESDSDSDSDSDSDSDSDSDSDSDSDSDSDSDSDSDSDSDSDSDSDSDSDSDSDSESDSDSDSDSDSDSDSDSDSDSDSESDSDSDSDSDSESDSDS

SEQ ID NO: 34531 - protein, 2285 aa, Staphylococcus aureus
  subsp. aureus 21252
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSESITSTTNSTSNQQEKLTSTSESTSSKNTTSSSDTKSVASTSSTEQPINTSTNQSTASNNTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSTSGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSASMSQDKSDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 34532 - protein, 681 aa, Staphylococcus aureus
  subsp. aureus 21252
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKNQLKDDKKSSLNNKNIQRDTTKNNNANPSDVNQGLEQAINDGKQSKAASQQQAKEAANSQGSNANNKLPLQSRTKESTSLNKSDQKSQPEIVRETEIEKVQPQQKNQSNDKMTSHHFNNEQEVNPQKDEKTLSVSDLKNNQKSPVEPTKDNDKKKGLNLLKSSAVATLPNKGTKELTAKATGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKIHLVGHSMGGQTIRQLEELLRNGSREEIEYQKQHGGEISPLFKGNHDNMISSITTLGTPHNGTHASDLAGNEALVRQVVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34533 - protein, 1366 aa, Staphylococcus aureus
  subsp. aureus 21252
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNAETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGIQELGEVGVKGVTVVAYDNKTNKEVGRTITDEKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDTGKHTPVKPMSATKDHHNKAKALPETGSENNGSNNATLFGGLFAALGSLLLFGRRKKQNK

SEQ ID NO: 34534 - protein, 51 aa, Staphylococcus aureus
  subsp. aureus 21252
MSAVKDHNNKAKALPETGTENNGSNNATLFGGLFAALGSLLLFGRRKKQNK

SEQ ID NO: 34535 - protein, 2450 aa, Staphylococcus aureus
  subsp. aureus 21252
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAGGAAQPAAGTTQPAVGTTQPAGQGNQADPNNAVQAQPGNQAAPANQAGQGNNQATPNNAAPANQTQPANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHFTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQTATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTTDQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKATQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 34536 - protein, 806 aa, Staphylococcus aureus
  subsp. aureus 21252
MTYRMKKWQKISTITLLMAGVITLNDGEFRSIDKHQIAVADTNVQTPDYEKLRNTWLDVNYGYDKYDEKNDAMKKKFDATEKEAEKLLSSMKTESDRKYLWSGTENLETNSSHMTRTYRNIEKIAEAMKHKNTKLKTDENKKKVKDALEWLHKNAYGKEPDKKVADLKTNFSKSAPQKNTNLNWWDYEIGTPKSLTNTLILLNDQFSNEKKKKYTAPIKTFAPKSDEILSSVGKAEQAKGGNLVDIAKVKLLESIIEEDKDMTKNSIDSFNKVFTYVQSKATGKERNGFYKDGSYIDHQDVPYTGAYGVVLLEGISQMMPMIKETPFNDSNQNDTTLKSWIDDGFMPLIYKGEMMDLSRGRAISRENETSHTASATVMKSLLRLSDAMDESTKAKYKQIVKTSVKSDSTYGQNDTLSSYSDISKMKSLMEDSTISTNGLTQQLKIYNDMDRVTYHNKDLDFAFGLSMTSKNVARYESINNENLKGWHTGAGMSYLYNSDVKHYRDNFWATADMKRLAGTTTLDNEEPKENKNSDKTFVGGTKFDDQHASIGMDFENQDKTLTAKKSYFILNDKIVFLGTGIKSTDSSKNPVTTIENRKANGYTLYTDDKQTTTSNDQETNSVFLESTDTKKNIGYHFLNKSKINVKKESHTGKWSEINKSQKTEDKKDEYYEVTQKHSNSDNKYGYVLYPGLSKDVFKSKASQVTVVKQDDDFHVVKDNESVWAGVNYSDSAKTFEINGTKVEVKAKGMFILKKKDDKTYECSFYNPESTNTDSDIEYKISMTGYSITNKNASTTNESGVRFELTK

SEQ ID NO: 34537 - protein, 141 aa, Staphylococcus aureus; identical to SEQ ID NO: 32806
  subsp. aureus 21252

SEQ ID NO: 34538 - protein, 258 aa, Staphylococcus aureus; identical to SEQ ID NO: 30410
  subsp. aureus 21252

SEQ ID NO: 34539 - protein, 165 aa, Staphylococcus aureus; identical to SEQ ID NO: 30805
  subsp. aureus 21252

SEQ ID NO: 34540 - protein, 256 aa, Staphylococcus aureus; identical to SEQ ID NO: 30153
  subsp. aureus 21252

SEQ ID NO: 34541 - protein, 242 aa, Staphylococcus aureus
  subsp. aureus 21252
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMFGGATLSGQYLNSARKIPINLWVNGKHKTISTDKIATNKKLVTAQEIDVKLRRYLQEEYNIYGHNNTGKGKEYGYKSKFYSGFNDGKVLFHLNNEKSFSYDLFYTGDGLPVSFLKIYEDNKIIESEKFHLDVEISYVDSN

SEQ ID NO: 34542 - protein, 239 aa, Staphylococcus aureus; identical to SEQ ID NO: 32822
  subsp. aureus 21252

SEQ ID NO: 34543 - protein, 254 aa, Staphylococcus aureus; identical to SEQ ID NO: 30809
  subsp. aureus 21252

SEQ ID NO: 34544 - protein, 227 aa, Staphylococcus aureus; identical to SEQ ID NO: 32844
  subsp. aureus 21252

SEQ ID NO: 34545 - protein, 232 aa, Staphylococcus aureus
  subsp. aureus 21252
MKLTVLAKATLVLGILTTGVMTAESQTVHAKVKLDETQRQYYINMLKDYYSQESYESTNISVKSEDYYGSNVLNFNQRNKNFKVFLIGDDRNKYKELMHGRDVFAVPELIDTKGGIYTVGGITKKNVRSVFGYVSHPGLQVKKVDPKDGFSIKELFFIQKEEVSLKELDFKIRKMLVEKYRLYKGASDKGRIVINMKDEKKHEIDLSEKLSFDRMFDVIDSKQIKNIEVNLN

SEQ ID NO: 34546 - protein, 231 aa, Staphylococcus aureus; identical to SEQ ID NO: 33938
  subsp. aureus 21252

SEQ ID NO: 34547 - protein, 234 aa, Staphylococcus aureus
  subsp. aureus 21252
MKMTAIAKASLALSILATGVITSTAQTVDASEHESKYENVTKDIFDLRDYYSGASKELKNVTGYRYSKGGKHYLIFDKNRKFTRIQIFGKYIERIKARKNPGLDIFVVKEAENRNGTVYSYGGVTKKNKGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIDKIEANIR

SEQ ID NO: 34548 - protein, 282 aa, Staphylococcus aureus; identical to SEQ ID NO: 32847
  subsp. aureus 21252

SEQ ID NO: 34549 - protein, 343 aa, Staphylococcus aureus; identical to SEQ ID NO: 32848
  subsp. aureus 21252

SEQ ID NO: 34550 - protein, 233 aa, Staphylococcus aureus; identical to SEQ ID NO: 32849
  subsp. aureus 21252

SEQ ID NO: 34551 - protein, 226 aa, Staphylococcus aureus; identical to SEQ ID NO: 32850
  subsp. aureus 21252

SEQ ID NO: 34552 - protein, 55 aa, Staphylococcus aureus; identical to SEQ ID NO: 33933
  subsp. aureus 21252

SEQ ID NO: 34553 - protein, 690 aa, Staphylococcus aureus
  subsp. aureus 21252
MLRGQEERKYSIRKYSIGVVSVLAATMFVVSSHEAQASEKTPTSNAAAQKETLNQSGEQGNAITSHQMQSGKQLDDMHKKNDKSGTVTEGKDTLQSSKHQSTQNSKTIRTQNDDQVKQDSERQGSKQSHQNNATNKTERQNDQVLNTHHAERNGSQSTTSQSNDVDKSQPSIPAQKVITNHDKAATTSTTPPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGSELANFYIGIINDLLSVEATEGKGTQLKAS

SEQ ID NO: 34554 - protein, 291 aa, Staphylococcus aureus; identical to SEQ ID NO: 30390
  subsp. aureus 21252

SEQ ID NO: 34555 - protein, 871 aa, Staphylococcus aureus
  subsp. aureus 21252
MNKHHPKLRSFYSIRKSTLGVASVIVSTLFLITSQHQAQAAENTNTSDKISENQNNNATTTQPPKDTNQTQPATQPANTAKTYPAADESLKDAIKDPALENKEHDIGPREQINFQLLDKNNETQYYHFFSIKDPADVYYTKKKAEVELDINTASTWKKFEVYENNQKLPVRLVSYSPVPEDHAYIRFPVSDGTQELKIISSTQIDDGAETNYDYTKLVFAKPIYNDPSLVKSDTNDAVVTNDQSSSNASNQTNTNTSNQNTSTNNNANDQSQATTNMSQPAQPKSSANADQASSQPAHETNSNGNNSDASNTSSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENFHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTSEPLNVQTGQEDKVTATDTAENSSTATNPKDASDKADVIEPESDVVKDADSSVDKDVQNDVDHLSDMSDNNHFDKYDLKEMDTQIAKDTNKGVDNSVGMISNNHIDKDINKNEGKVIQLAHNADKNKVAGNRSTEHPSSDIHKTVDKTVKTKEKASTPSKKNKLGQSKMLPKTGETTSSQSWWGLYALLGMLALFIPKFRKESK

SEQ ID NO: 34556 - protein, 2182 aa, Staphylococcus aureus
  subsp. aureus 21252
MNLLKKNKYSIRKYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLATNNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAVLGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNVTYDATNRIITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKVAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSASGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDTVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQNIDNTTQDAAVNDVRNQTIKAIEQIKPKVRRKRAALDNIDESNNNQLAAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEATDEEQNAAIAQVEQALIKAKQHIASAVTNADVAYLLHDGKNEIREIEPVINRKASAREQLTTLLNDKKQAIEANVQATVEERNSVLAQLQNIYDAAIGQLDHDRSNAQVDKTASFNLQTIQGLDVHPVKKPEAEKTINQDIARVTHLVQNYRKVSDRNKADALKAITALKLQMDEELKTARTNADVDAVLKRFNVALGDIEAVITEKEHSLMRIENIAQQTYAKFKAIATPEQLAKVKALIDQYVADGNRMIDEDATLNDIKQHTQFIIDEILAIKLPAEVIKASPKVGQPAPKVCTPIKKEDKQEVRKVEKELPNTGSEEMDLPLKELALITGAALLARRRTKNEKES

SEQ ID NO: 34557 - protein, 231 aa, Staphylococcus aureus; identical to SEQ ID NO: 32843
  subsp. aureus 21252

SEQ ID NO: 34558 - protein, 231 aa, Staphylococcus aureus; identical to SEQ ID NO: 33931
  subsp. aureus 21252

SEQ ID NO: 34559 - protein, 993 aa, Staphylococcus aureus
  subsp. aureus 21252
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSTSDSDSASDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSDSDSDSDSDSDSDSDSDSDLASDSDSASDSDSASDSDSDSDSDSDSDSDSDSDSDSNSDSDSDSDSDSDSDSDSDSDSDSDSDSDSDSDSDSDNDSDSDSDSDSASDSDSGSDSDSSSDSDSDSDSDSASDSDSDSTSDTGSDNDSDSSSDSDSDSDSDSDSDSDSDSDNDSDSASDSDSDSDSESGSNNNVVPPNSPKNGTNASNKNEAKDSKEPLPDTGSEDEANTSLIWGFLASLGSLLLFRRKKENKDKN

SEQ ID NO: 34560 - protein, 434 aa, Staphylococcus aureus [sequence omitted]

SEQ ID NO: 34561 - protein, 443 aa, Staphylococcus aureus
  subsp. aureus 21252
MRDKKGPVNKRVDFLSNKLNKYSIRKFTVGTASILIGSLMYLGTQQEAEAAENNIENPTTLKDNVQSKEVKIEEVTNKDTAPQGIEVKSEVTSNKDTIEHGPSVKAEDISKKEDTPKEVANVAEVQPKSSVTHNAETPKVRKARSVDEGSFDITKDSKNVVESTPITIQGKEHFEGYGSVDIQSNPEDLKVSEVTRFNNKSIGRNELTGALQLKNKVSFKNDFEFNIRIANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSVDTTDGKFHGQLLNNLKLAYNEKSGIMRAEYAGKVWEANISDLGLDKSEVYNFLITSSQRQGTSQGVYANGWMRTDLNNSTFKLTPNLVNKTETKTVEIPFETKREFNP

SEQ ID NO: 34562 - protein, 643 aa, Staphylococcus aureus
  subsp. aureus 21252
MGVTVNGRIHTLNKEEGKFSHFAYVKPNNQSLSSVTVTGQVTSGYKQDGGNPTVRVYKYTGKEGLAESVFADLSKNDQYEDITSQLSISYNSGGYTINFESLDNNKDYVIKYEGAYDAKSESLQLQTHLSAYNDYYYYPYYPVQLTWKNGVAFYSNNAQGDGKDKPNDPIIEKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPSYQFGGHNGIDFVEDTLPQVSGHNEGQQTIEEDTTPPIVPPTPPTPEVPSEPEIPTPEVPSEPETPTPPTPTPPTPEVPSEPETPTPPTPEVPAEPGKPVPPAKEEPKKPSKPVEQGKVVTPVIEINEKVKPVAPTKQKQSKKSELPETGGEESTNKGMLFGGLFSILGLTLLRRNKKNNKA

SEQ ID NO: 34563 - protein, 233 aa, Staphylococcus aureus
  subsp. aureus 21252
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLSAWGF

SEQ ID NO: 34564 - protein, 94 aa, Staphylococcus aureus
  subsp. aureus 21252
SDPDPDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 34565 - protein, 331 aa, Staphylococcus aureus
  subsp. aureus 21252
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSIAPTNAKGTFVVADVTIKNKGKEALTIDSSMFKLKSGDKTFEADNTGSMSANQNDNGSIENSFFLQRINPDSTAQGKIVFDVSENIANAKDKKLEVISSLFSVKKITFDLSDAKKTSKAKKDKQDTEVAVTSSNSDNVNYEASATTPATTSSADTDSEDSEKSSKDEDKQNASKSDKSSVEKSESNEETTPVEPMPHSKPTTSEAPPSQNIHNEDSMYDASTE

SEQ ID NO: 34566 - protein, 689 aa, Staphylococcus aureus
  subsp. aureus 21252
MKFKSLITTTLALGVIASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKVNNQVPYSINLNGTTTNIQSNLAFSNKPWTNYKNLTTKVKSVLKSDRGVSERDLKHAKKAYYTVYFKNGGKRVIHLNSNIYTANLVHAKDVKRIEVTVKTVSKVKAERYVPYTIAVNGASNPTLSDLKFTGDSRVSYSDITKKVKSVLKHDRGIGERELKYAKKATYTVHFKNGTKKVINLNSNISQLNLLYVKDIKNIDIDVKTGAKAKADSYVPYTIAVNGTTTPIASKLKLSNKQLIGYQDLNKKVKSVLKHDRGINDIELKFAKQAKYTIHFKNGKTQVVDLKSDIFTRNLFSVKDIKKIDINVKQQSKSNKALNKVTNKATKVKFPVTINGFSNLVSNEFAFLHPHKITTNDLNAKLRLALASDQGITKHDIGLSERTVYKVYFKDGSSKFVDLKAAKQDSKVFKATDIKKVDIEIKF

SEQ ID NO: 34567 - protein, 330 aa, Staphylococcus aureus
  subsp. aureus 21252
MVKKTKSNTLKKAATLALANLLLIGALTDNSAKAETKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34568 - protein, 339 aa, Staphylococcus aureus; identical to SEQ ID NO: 32812
  subsp. aureus 21252

SEQ ID NO: 34569 - protein, 351 aa, Staphylococcus aureus; identical to SEQ ID NO: 32811
  subsp. aureus 21252

SEQ ID NO: 34570 - protein, 682 aa, Staphylococcus aureus
  subsp. aureus 21259
MKFKSLITTTLALGVIASTGANFNTNEASAAAKPLDKSSSTLHHGHSNIQIPYTITVNGTSQNILSSLTFNKNQNISYKDIENKVKSVLYFNRGISDIDLRLSKQAEYTVHFKNGTKRVIDLKSGIYTADLINTSDIKAISVNVDTKKQPKDKAKANVQVPYTITVNGTSQNILSNLTFNKNQNISYKDLEGKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKTGSKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAIANDQGITKHDIELAERAVYKVYFKNGSSKYVDLKTEYKDERVFKATDIKKVDIELKF

SEQ ID NO: 34571 - protein, 274 aa, Staphylococcus aureus; identical to SEQ ID NO: 30872
  subsp. aureus 21259

SEQ ID NO: 34572 - protein, 338 aa, Staphylococcus aureus
  subsp. aureus 21259
MIKQLCKNITICTLALSTTFTVLPATSFAKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHNVKFVKVLNDNEKK

SEQ ID NO: 34573 - protein, 321 aa, Staphylococcus aureus
  subsp. aureus 21259
MKNKKRVLIASSLSCAILLLSAATTQANSAHKDSQDQNKKEHVDKSQQKEKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKIKKVKD

SEQ ID NO: 34574 - protein, 815 aa, Staphylococcus aureus; identical to SEQ ID NO: 31288
  subsp. aureus 21259

SEQ ID NO: 34575 - protein, 141 aa, Staphylococcus aureus; identical to SEQ ID NO: 30633
  subsp. aureus 21259

SEQ ID NO: 34576 - protein, 62 aa, Staphylococcus aureus; identical to SEQ ID NO: 30610
  subsp. aureus 21259

SEQ ID NO: 34577 - protein, 138 aa, Staphylococcus aureus
  subsp. aureus 21259
MGEFEVKYLTGFILILLLEGIFTNSASAIEYSDLHHKSKLNSKRLYNAKLSFANPTDLENKNTNDRLLKHDLLFHDMFVNVASKKDFKVEFENEALSKKFINKNIDIYAGSYSYECHGGATNKTQCSYGGVTLSDNNK

SEQ ID NO: 34578 - protein, 291 aa, Staphylococcus aureus; identical to SEQ ID NO: 30390
  subsp. aureus 21259

SEQ ID NO: 34579 - protein, 233 aa, Staphylococcus aureus; identical to SEQ ID NO: 30428
  subsp. aureus 21259

SEQ ID NO: 34580 - protein, 680 aa, Staphylococcus aureus
  subsp. aureus 21259
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSLTNATTEETPVTGEATTATNQANTPATTQSSNTNAEELVNQTSNETTSNDTNTVSSVNSPQNSTNAENVSTTQDTSTEATPSNNESAPQSTDASNKDLVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSASDSDSASDSDSASDSDSASDSDSASDSDSASDSDSASDSDSASDSDSASDSDSDSDSDSDSDSDSDSDSDSDSDSASDSDSASDSDSDSDSDSDS

SEQ ID NO: 34581 - protein, 240 aa, Staphylococcus aureus
  subsp. aureus 21259
MKKRLLFVIVITLFIFSSNHTVLSNGDVGPGNLRNFYTKYEYVNLKNVKDKNSPESHRLEYSYKNDTLYAEFDNEYITSDLKGKNVDIFGISYKYGSNSRTIYGGVTKAENNKLGSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEISKR

SEQ ID NO: 34582 - protein, 266 aa, Staphylococcus aureus; identical to SEQ ID NO: 30409
  subsp. aureus 21259

SEQ ID NO: 34583 - protein, 234 aa, Staphylococcus aureus; identical to SEQ ID NO: 30395
  subsp. aureus 21259

SEQ ID NO: 34584 - protein, 434 aa, Staphylococcus aureus
  subsp. aureus 21259
MPIITDVYAREVLDSRGNPTVEVEVLTESGAFGRALVPSGASTGEHEAIELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFNNLDK

SEQ ID NO: 34585 - protein, 231 aa, Staphylococcus aureus; identical to SEQ ID NO: 33623
  subsp. aureus 21259

SEQ ID NO: 34586 - protein, 39 aa, Staphylococcus aureus
  subsp. aureus 21259
MNKQQSKVRYSIRKVSIGILSISIGMFFGIGYVEQSICR

SEQ ID NO: 34587 - protein, 227 aa, Staphylococcus aureus
  subsp. aureus 21259
MKLKNIAKASLALGILTTGMITTTAQPVKASTLEARSQATQDLKDYYNRPYFDLRNLSGYREGNTVTFINHYQQTDVKLEGKDKDKIKDGNNDNLDVFVVREGFGRQADNNSIGGITKTNGTQHKDTVQNVNLLVYKSTGQNTTSVTSTNYSIYKEEISLKELDFKLRKHLIDNNGLYNTEPKDSKIKVTMQNGDFYTFELNKKLQTHRMGDVIDGTKIKEINVELN

SEQ ID NO: 34588 - protein, 227 aa, Staphylococcus aureus; identical to SEQ ID NO: 31334
  subsp. aureus 21259

SEQ ID NO: 34589 - protein, 232 aa, Staphylococcus aureus
  subsp. aureus 21259
MKFTELAKATLALGILTTGVFTAESKAVHAKVELDETQRKYYINMLHQYYSEESFEPTNISVKSEDYYGSNVLNFNQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFDRMFDVMDSKQIKNIEVNLN

SEQ ID NO: 34590 - protein, 232 aa, Staphylococcus aureus
  subsp. aureus 21259
MKFTVIAKAIFVLGILTTSAMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGAADKGRIVINMKDENKYEIDLSDKLDFERMADVINSEQIKNIEVNLK

SEQ ID NO: 34591 - protein, 231 aa, Staphylococcus aureus; identical to SEQ ID NO: 34063
  subsp. aureus 21259

SEQ ID NO: 34592 - protein, 234 aa, Staphylococcus aureus; identical to SEQ ID NO: 33390
  subsp. aureus 21259

SEQ ID NO: 34593 - protein, 308 aa, Staphylococcus aureus
  subsp. aureus 21259
MKITMIAKTSLALGLLTTGVITTTTQAAKASTPSSTKVEAPQSTPPSTKVEAPQSKPNATTPSSTKVEAPQQTANATTPPSTKVTTPPSTNTPQPMQSTKSDTPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 34594 - protein, 369 aa, Staphylococcus aureus; identical to SEQ ID NO: 33375
  subsp. aureus 21259

SEQ ID NO: 34595 - protein, 231 aa, Staphylococcus aureus
  subsp. aureus 21259
MKMKSIAKISLLLGILATGVSTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 34596 - protein, 226 aa, Staphylococcus aureus
  subsp. aureus 21259
MKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTPILEIKKDNEDVLKDFYYISKEDISLKELDYRLRERAIKQHGLYSNGLKQGRITITMKDGKSHTIDLSQKLEKERMGDSIDGRQIQKILVEMK

SEQ ID NO: 34597 - protein, 203 aa, Staphylococcus aureus; identical to SEQ ID NO: 31344
  subsp. aureus 21259

SEQ ID NO: 34598 - protein, 691 aa, Staphylococcus aureus; identical to SEQ ID NO: 33577
  subsp. aureus 21259

SEQ ID NO: 34599 - protein, 126 aa, Staphylococcus aureus
  subsp. aureus 21259
DSDSDSDSDSDSDSDSDSDSDSDSDSDSDSSSDSDSDSDSDSSSDSDSESDSNSDSESGSNNNVVPPNSPKNGTNASNKNEAKDSKEPLPDTGSEDEANSSLIWGLLASLGSLLLFRRKKENKDKK

SEQ ID NO: 34600 - protein, 102 aa, Staphylococcus aureus
  subsp. aureus 21259
SDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 34601 - protein, 1141 aa, Staphylococcus aureus
  subsp. aureus 21259
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTDRSTKPVATAPTSVAPKRVNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34602 - protein, 427 aa, Staphylococcus aureus
  subsp. aureus 21259
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKVWEANISDLGLDKSEAYNFLITSSQRQGTSQGVYANGWMRTDLNNSTFKLTPNLVKKTE

SEQ ID NO: 34603 - protein, 906 aa, Staphylococcus aureus
  subsp. aureus 21259
MIVVGMGQEKEAAASEQNNTTVEESGSSATESKASETQTTTNNVNTIDETQSYSATSTEQPSQSTQVTTEEAPTTVQAPKVETSRVDLASEKVADKKTTGTQVDTAQPSNVSEIKPRMKRSTDVAEVAEKEVVEEAKATGTDVTSKVTVENGSEIVGHKQDTNVVNPHNAERVTLKYKWKFGEGIKAGDYFDFTLSDNVETHGISTLRKVPEIKSSTEDKVMANGQVIGERKIRYTFTDYIDNKKDLTAELTLNLFIDPTTVTKQGMEKVEVSLGQNKVSKEFDIKYLDGVKDRMGVTVNGRIDTLNKADGKFSHFAYVKPNNQSLSSVTVTGQVTSGYKQNVKNPTVKVYKHIGSDELAESIYAKLDDVSKFEDVTGELTLQYTSNGGYSLNFNNLDQSKNYVIKYEGDYDSNASTLEFQTHLFGYYNYYYYNTSNLTWKNGVAFYSNNAQGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENYQHISHSGLGTENGHGNYGVIEEIEENSHVDIKSELGYEGGQNSGNQSFEEDTEEDKPKYEQGGNIVDIDFDSVPQIQGQNNGDQSFEEDTEEDKPKYEQGGNIIDIDFDSVPHIHGFNKHTEIIEEDTNKDKPNYQFGGHSSVDFEEDTLPQVSGHNEGQQTIEEDTTPPIVPPTPPTPEVPSEPEVPTPPTSEIPSEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 34604 - protein, 1004 aa, Staphylococcus aureus
  subsp. aureus 21259
MIVVGMGQDKEAAASEQKTTTVEENGNSATDNKVNETQTTTTNVNTIDETQSFSATATEQPSNATQVTTEKAPKAVQAPQTAQPANLETVKEEVVKEEAKPQVETTQPQDNSGDQRQVDLTPKKTTQNQVAETQVEVAQPRTASESKPRVTRSADVVEAKEASDAKVETGTDVTSKVTVTESSIEGHNNTNKVEPHAGQRAVLKYKLKFENGLHQGDYFDFTLSNNVNTHGVSTARKVPEIKNGSVVMATGKILEGGKIRYTFTNDIEDKVDVTAELEINLFIDPKTVQTNGNQTITSTLNGEQTSKELDVKYKDGIGNYYANLNGSIETFNKANNRFTHVAFIKPNNGKTTSVTVTGTLMKGSNQNGNQPKVRVFEYLGNNEDIAKSVYANTTDTSKFKEVTSSMNGNLNVQTNGSYSLNLENLDKTYVVHYDGEYLNGTDEVDFRTQMVGHPEQLYKYYYDRGYTLTWDNGLVLYSNKANGNGKNGPIIQNNKFEYKEDTIKETLKGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKDIVTGAVSDHTTIEDTKEYTTEINLIELVDELPEEHGQAQGPIEEITENNHHISHSGLGTENGHGNYGVIEEIEENSHVDIKSELGYEGGQNSGDQSFEEDTEEDKPKYEQGGNIVDIDFDSVPQIHGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPPAPEVPSEPGEPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKFELPETGGEESTNKGMLFGGLFSILGLALLRRNKKNNKA

SEQ ID NO: 34605 - protein, 892 aa, Staphylococcus aureus
  subsp. aureus 21259
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSMINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDMVKDTDSSVDKDAHLNIDHSSTNMMNNTHFDKYDLKEMDTQIAKDTDKGVDNSVGMSSNVDTDKDSNKNKDKVIQLNHIADKNNHTGKAAKLDVVKQNYNNTIKVTDKKTTEHLPNDIHKTVDKTVKTKEKAGTPSKENKLSQSKMLPKTGETTSSQSWWGLYALLGMLALFIPKFRKESK

SEQ ID NO: 34606 - protein, 1406 aa, Staphylococcus aureus
  subsp. aureus 21259
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSKRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSADAKNYQAQGNVIALGRIKGNDTNDHGDFNGIEKTLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYQVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVRTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNLDRQQAIESIKQANTNAEVDQAATVAENNIDAVQVDVVKKQAARDKITAEVAKRIEAVKQTPNATDEEKQAAVNQINQLKDQAFNQINQNQTNDQVDTTTNQALKAIDNVEAEVVIKPKAIADIEKAVKEKQQQIDNSLDSTDNEKEVASQALAKEKKKHLQLLTKLKRIVR

SEQ ID NO: 34607 - protein, 331 aa, Staphylococcus aureus
  subsp. aureus 21259
MSNQFKSEEERRQWEQFQAFQNQQNQQNQQYGQKKSKKGWFWGCGGCLVLFILIIIGISACTAGITGNLGGNSSKETNKTHKIGETVKNGDLEITVNSVETMKSVGPSLAPTNAKGTFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKSKKDKQDTEVAVASSNSDNVNYEASATTPATTSSADTDSEDSEKSSKDEDKQNASKSDKDSVEKSESNEETAPVEPMPQSKPTTSEAPPSQNIHNEDSMYDASTE

SEQ ID NO: 34608 - protein, 327 aa, Staphylococcus aureus; identical to SEQ ID NO: 30616
  subsp. aureus 21259

SEQ ID NO: 34609 - protein, 311 aa, Staphylococcus aureus; identical to SEQ ID NO: 30617
  subsp. aureus 21259

SEQ ID NO: 34610 - protein, 258 aa, Staphylococcus aureus
  subsp. aureus 21259
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGDCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 34611 - protein, 231 aa, Staphylococcus aureus
  subsp. aureus 21259
MRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEERVIGVNVFKDGVQQEGFVIKTKKAKVTVQELDTKVRFKLENLYKIYNKDTGNIQKGCIFFHSHNHQDQSFYYDLYNVKGSVGAEFFSIL

SEQ ID NO: 34612 - protein, 238 aa, Staphylococcus aureus; identical to SEQ ID NO: 33836
  subsp. aureus 21259

SEQ ID NO: 34613 - protein, 142 aa, Staphylococcus aureus
  subsp. aureus 21259
MKKFKYSFILVFILLFNIKDLTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKN

SEQ ID NO: 34614 - protein, 239 aa, Staphylococcus aureus; identical to SEQ ID NO: 30622
  subsp. aureus 21259

SEQ ID NO: 34615 - protein, 254 aa, Staphylococcus aureus; identical to SEQ ID NO: 33839
  subsp. aureus 21259

SEQ ID NO: 34616 - protein, 321 aa, Staphylococcus aureus; identical to SEQ ID NO: 30959
  subsp. aureus 21259

SEQ ID NO: 34617 - protein, 315 aa, Staphylococcus aureus; identical to SEQ ID NO: 30573
  subsp. aureus 21259

SEQ ID NO: 34618 - protein, 325 aa, Staphylococcus aureus; identical to SEQ ID NO: 30407
  subsp. aureus 21259

SEQ ID NO: 34619 - protein, 196 aa, Staphylococcus aureus
  subsp. aureus 21259
MIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNKPVHSMDKNDKVKKSKIAKKSVANQEKKRAELPKTGAESTQKGLIFSSIIGIAGLMLLARRRKN

SEQ ID NO: 34620 - protein, 241 aa, Staphylococcus aureus; identical to SEQ ID NO: 31311
  subsp. aureus 21259

SEQ ID NO: 34621 - protein, 241 aa, Staphylococcus aureus; identical to SEQ ID NO: 33879
  subsp. aureus 21259

SEQ ID NO: 34622 - protein, 238 aa, Staphylococcus aureus; identical to SEQ ID NO: 33880
  subsp. aureus 21259

SEQ ID NO: 34623 - protein, 319 aa, Staphylococcus aureus; identical to SEQ ID NO: 30605
  subsp. aureus 21259

SEQ ID NO: 34624 - protein, 165 aa, Staphylococcus aureus; identical to SEQ ID NO: 31315
  subsp. aureus 21259

SEQ ID NO: 34625 - protein, 109 aa, Staphylococcus aureus; identical to SEQ ID NO: 33345
  subsp. aureus 21259

SEQ ID NO: 34626 - protein, 350 aa, Staphylococcus aureus
  subsp. aureus 21259
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVLPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 34627 - protein, 644 aa, Staphylococcus aureus
  subsp. aureus 21259
MNKQQKEFKSFYSIRKSSLGVASVAISTLLLLMSNGEAQAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVVKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 34628 - protein, 1244 aa, Staphylococcus aureus
  subsp. aureus 21259
MLNRENKTAITRKGMVSNRLNKFSIRKYTVGTASILVGTTLIFGLGNQEAKAAESTNKELNEATTSASDNQSSGKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKSAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 34629 - protein, 955 aa, Staphylococcus aureus
  subsp. aureus 21259
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDNDSDSDSDSDNDSDSDSDSDAGKHTPAKPMSTVKDQHKTAKALPETGSENNNSNNGTLFGGLFAALGSLLLFGRRKKQNK

SEQ ID NO: 34630 - protein, 241 aa, Staphylococcus aureus; identical to SEQ ID NO: 31350
  subsp. aureus 21259

SEQ ID NO: 34631 - protein, 61 aa, Staphylococcus aureus; identical to SEQ ID NO: 34190
  subsp. aureus 21259

SEQ ID NO: 34632 - protein, 681 aa, Staphylococcus aureus
  subsp. aureus 21259
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKVTDTKQA

SEQ ID NO: 34633 - protein, 2023 aa, Staphylococcus aureus
  subsp. aureus 21259
MSKRQKEFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSGSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESMSTSDSISEAISASESTSISLSESNSTSDSESQSASAFLSESLSESTSESTSESVSSSTSASTSLSDSTSESGSTSTSLSNSTSGSASISTSTSNSESTSTFKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 34634 - protein, 688 aa, Staphylococcus aureus
  subsp. aureus 21259
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPEPEPTPDPEPSPDPDPEPTPDPEPSPDPDPDSDSDSDSESDSDSDSDSDSDSDSDSGSDSDSDSDSDSESDSDSESDSESDSDSDSDSDSDSDSDSDSDSDSDSDSDSDSDSDS

SEQ ID NO: 34635 - protein, 1809 aa, Staphylococcus aureus
  subsp. aureus 21259
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVIDKINAIQTQAKVKPAADTEVENAYNTRKQEIQNSNASTTEEKQAAYTELDTKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPQAKQAIADKVQAQETAIDANNGSTTEEKTAAKQQAQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKKQLQQIYMLMQIKRKIIFQLTLMQHKMKSNKQLSKLTKMFKLH

SEQ ID NO: 34636 - protein, 108 aa, Staphylococcus aureus
  subsp. aureus 21259
SDSDSDSDSDSDSDSESDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 34637 - protein, 691 aa, Staphylococcus aureus
  subsp. aureus 21262
MLRGQEERKYSIRKYSIGVVSVLAATMFVVTSHEAQASEKTPTTNAAAQKETLNQPGEQGNAITSHQMQSGKQLDDMHKENGKSGTVTEGKDTRQSSNHQSTQISKTIRTQNDNQVKQDSERQGSKQSHQNNATNKTERQNDQVQNTHHAERNGSQSTTSQSNDVDKSQPSIPVQKVIPNHDKAAPTSTTPPSNDKTAPKSTKAQNATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATEGKGTQLKAS

SEQ ID NO: 34638 - protein, 884 aa, Staphylococcus aureus
  subsp. aureus 21262
MNNKKTATNRKGMIPNRLNKFSIRKYSVGTASILVGTTLIFGLSGHEAKAAERTNGELNQSKNETTAPSENKTTEKVDSHQQNNIEQSTTSNQPKVNESDNTSVKETTEEPQNTTSTQPTKQNNDATANKDNLAAQNISTQAKDVSATPKTTTIKPRTLNRMAVNTVAAPQQGTNVNDKVHFSNIDIAIDKGHVNKDTGKTEFWATSSDVLKLKANYTIDDSVKEGDTFTFKYGQYFRPGSVRLPSQTQNLYNAQGNIIAKGIYDSKTNTTTYTFTNYVDQYTNVSGSIEQVAFAKCENATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTGQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDADSDSDAGKHTPVKPMSTTKDHHNKAKALPETGSENNNLNNGTLFGGLFAALGSLLLFGRRKKQNK

SEQ ID NO: 34639 - protein, 1091 aa, Staphylococcus aureus
  subsp. aureus 21262
MLNRENKTAMTRKGMVSNRLNKFSIRKYTVGTASILVGTTLIFGLGNQEAKAAEVTNKEMKEDATSVNNDQVSKKVDTEQLNNGGNTSKVDTEQLKDENINKVANQKEVTRVENSVASEKNNNSKPSENGKLQTSDVKKTEDNNATSDDQVTTTVNSQQLNTDNTTSMSSALINVRKDDLKINNEEVRNVGEKSDNTDNANSSELIKPKTTEPKRLNTRMRMAAIQPNSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNSITYTFTDYVDRFNSVQMGINYSIYMDADTIPVSKNDVEFNVAIGNTTTKTTANIQYPDYVSRDNNSIGSAFTETVSHAGNAEDPGYYIQTVYVNPSEKSLTNAKLKVEAYHKDYPDNVGQINKNVTKIKIYQAPKDYVLNKGYDVNTNQLIDVTEQFKDKITYGTNDNVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNRNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVD

SEQ ID NO: 34640 - protein, 233 aa, Staphylococcus aureus
  subsp. aureus 21262
SDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSESDSDSDSDSDSDSDSDSESDSNSDSESDSNSDSESGSNNNVVPPNSPKNGTNASNKNEAKDSKEPLPDTGSEDEANTSLIWGLLASLGSLLLFRRKKENKDKK

SEQ ID NO: 34641 - protein, 2266 aa, Staphylococcus aureus
  subsp. aureus 21262
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASTATTTALTANTITVNKDNLKQYMTTSGNATYDQSTGIVTLTQDTYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQNFDITYNGDTKVMTVTYAGQTWTRNISDWITKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPAVTPIGDKSSEVFSPISPIKIATQDNSGNAVTNTVTGLPSGLTFDSTNNTISGTPINIGTSTITIVSTDASGNKTTTTFKYEVTRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISTSSSTEKSESLSTSTSDSLRTSTSLSDSVSMSTSGSLSKSQSLSTSTSDSASTSQSVSDSTSNSISTSESLSESVSTSESISISNSISNSVSASTSKSESQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSSSVRMSESQSTSGSMSTSQSDSTSISTLFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSESTSESTSMSLSVSQSTSGSTSLSTSESLSDSTSTSLSLSASMNQSGVDSNSASQSASVSTSTSTSESDSQSTSSYTSQSTSQSESTSTSTSLSDSTSISRSTSQSGSTSTSASLSGSESESDSQSISTSTSESKSESTSTSLSDSTSTSNSGSASTSTSLSNSASISESDSSSTSLSDSKSASMQSSESDSQSTSTSLSNSQSTSTSNRMSTIASESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESSSLSDSMSMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSTSTSESLSDSMAQSQSTSTSASGSLSTSISSSMSASASTSKSQSTSVSTSLSTSDSISDSTSISISGSQSAVESESTSDSTSISDSESLSTSGSTSDSTSISDSESLSTSNSGSTSVSDSSSTSSSLSTSGSTSVSDSTSMSDSESVSTSASTSLSTSNSESASVSISDSTSTSMSNSISMSDSTSSSMSNSMSMSTSESNSIHPSNSMSTSQTHFTSTSISTSESIAPNTNESHSTLSATSVSSKHDAEPAQREERLPDTGDSIKQNGLLGGVMTLLVGLGLMKRKKKKDENDQDDSQA

SEQ ID NO: 34642 - protein, 681 aa, Staphylococcus aureus
  subsp. aureus 21262
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEAPPLNKSDQTSQRKIVNKTEIEKVQPQQNNQANDKITKHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRQTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34643 - protein, 157 aa, Staphylococcus aureus
  subsp. aureus 21262
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNN

SEQ ID NO: 34644 - protein, 235 aa, Staphylococcus aureus
  subsp. aureus 21262
FGGEKIPQGHKDIFDPNLPTDQTEKVPGKPGIKNPDTGKVIEEPVDDVIKHGPKTGTPETKTVEIPFETKREFNPKLQPGEERVKQEGQTGSKTITTPITVNPLTGEKVGEGQPTEEITKQPVDKIVEFGGEKSKDPKGPEKSEKPSRPTHPSGPVNPDNPGLSKDRVKPNDPVHSMDKNDKVKKSKIAKESVANQEKKRAELPKTGVESTQKGLIFSSIIGIAGLMLLARRRKN

SEQ ID NO: 34645 - protein, 108 aa, Staphylococcus aureus
  subsp. aureus 21262
EDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34646 - protein, 234 aa, Staphylococcus aureus; identical to SEQ ID NO: 30395
  subsp. aureus 21262

SEQ ID NO: 34647 - protein, 266 aa, Staphylococcus aureus; identical to SEQ ID NO: 30409
  subsp. aureus 21262

SEQ ID NO: 34648 - protein, 240 aa, Staphylococcus aureus
  subsp. aureus 21262
MKKRLLFVIVITLFIFSSNHTVLSNGDVGPGNLRNFYTKYEYVNLKNVKDKNSPESHRLEYSYKNDTLYAEFDNEYITSDLKGKNVDIFGISYKYGSNSRTIYGGVTKAENNKLDSPRIIPINLIINGKHQTVTTKSVSTDKKMVTAQEIDVKLRKYLQNEFNIYGHNDTGKGKEYGTSSKFYSGFDKGSVVFHMNDGSNFSYDLFYTGYGLPESFLKIYKDNKTVDSTQFHLDVEISKR

SEQ ID NO: 34649 - protein, 238 aa, Staphylococcus aureus
  subsp. aureus 21262
MNKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 34650 - protein, 241 aa, Staphylococcus aureus
  subsp. aureus 21262
MNNNITKKIILSTTLLLLGTASTQFPNTPISSSTEAKAYYINQNETNVNELTKYYSQQHLTFSNKTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 34651 - protein, 241 aa, Staphylococcus aureus
  subsp. aureus 21262
MKKNIMNKLVLSTALLLLGTTSTQLPKTPISFSSEAKAYNISENETNINELIKYYSQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 34652 - protein, 629 aa, Staphylococcus aureus
  subsp. aureus 21262
MNMKKKEKHAIRKKSIGVASVLVGTLIGFGLLSSKEADASENSVTQSDSASNESKSNDSSSVNAAPKTDNANLSDTKTTSNSNNGETSVAQNPAQQETTQSASTNATTEETPATGEATTTATNQANTPATTQSSNTNAEELVNQTSNETTSNDTNTVSSVNSPQNSTNAENVSTTQDTSTEATPSNNESAPQSTDASNKDVINQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTDSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPDSDSGSDSGSDSNSDSGSDSGSDSTSDSDSDSASDSDSASDSDSASDSDSASDSDSASDSDSAS

SEQ ID NO: 34653 - protein, 231 aa, Staphylococcus aureus
  subsp. aureus 21262
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSADQANQVQSQEVEAPQNAQTQQPQASTSNNTQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 34654 - protein, 227 aa, Staphylococcus aureus; identical to SEQ ID NO: 33558
  subsp. aureus 21262

SEQ ID NO: 34655 - protein, 227 aa, Staphylococcus aureus
  subsp. aureus 21262
MKFTALAKATLALGILTTGTLTTEAHSSHAKQNQETVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGEAIESKQIKDIEVNLK

SEQ ID NO: 34656 - protein, 232 aa, Staphylococcus aureus
  subsp. aureus 21262
MKFTALAKATLALGILTTGVITAESQTGHAKVELDETQRKYYINMLHQYYSEESFEPTNISVKSEDYYGSNVLNFNQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKKIKNIEVNLN

SEQ ID NO: 34657 - protein, 51 aa, Staphylococcus aureus
  subsp. aureus 21262
MSAVKDHHNKAKALPETGSENNGSNNATLFGGLFAALGSLLLFGRRKKQNK

SEQ ID NO: 34658 - protein, 915 aa, Staphylococcus aureus
  subsp. aureus 21262
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTTSSTQQQQNNVPATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDGELDIAQGTSMRTTDNYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVD

SEQ ID NO: 34659 - protein, 36 aa, Staphylococcus aureus
  subsp. aureus 21262
MENKNNRYSIRKFSVGVGSILIASFIMIFQNEAHAS

SEQ ID NO: 34660 - protein, 331 aa, Staphylococcus aureus
  subsp. aureus 21262
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSEDSDSEDSEKSNKDEDKQNASKSDKSSVEKSESNEETTPVDPMRQSKPTTSEAPPSQNIHNEDSMYDASTE

SEQ ID NO: 34661 - protein, 315 aa, Staphylococcus aureus
  subsp. aureus 21262
MLKNKILATTLSVSLLAPLANPLLENAKAANDTEDIGKGSDIEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGSNGSFNYSKSISYTQQNYVSEVEQQNSKSVLWGVKANSFATESGQKSAFDSDLFVGYKPHSKDPRDYFVPDSDLPPLVQSGFNPSFIATVSHEKGSSDTSEFEITYGRNMDVTHAIKRSTHYGNSYLDGHRIHNAFVNRNYTVKYEVNWKTHEIKVKGQN

SEQ ID NO: 34662 - protein, 321 aa, Staphylococcus aureus; identical to SEQ ID NO: 30959
  subsp. aureus 21262

SEQ ID NO: 34663 - protein, 325 aa, Staphylococcus aureus; identical to SEQ ID NO: 30407
  subsp. aureus 21262

SEQ ID NO: 34664 - protein, 311 aa, Staphylococcus aureus
  subsp. aureus 21262
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 34665 - protein, 327 aa, Staphylococcus aureus
  subsp. aureus 21262
MKMKKLVKSSVATSIALLMLSNTVDAAQHITPVSEKKVDDKITLYKTTATSDNDKLNISQILTFNFIKDKSYDKDTLVLKAAGNINSGYKKPNPKDYDYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQISSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 34666 - protein, 321 aa, Staphylococcus aureus
  subsp. aureus 21262
HTGAGMSYLYNSDVKHYRDNFWATADMKRLAGTTTLDNEEPKENKNSDKTFVGGTKFDDQHASIGMDFENQDKTLTAKKSYFILNDKIFFLGTGIKSTDSSKNPVTTIENRKANGYTLYTDDKQTTASDNQGTNSVFLESPNKPKNNIGYHFLNKPKITVKKESHTGKWSDINKSQKDTQKTDEYYEVTQKHSDKDDKYGYVLYPGISKNVFNTKKDLVTIVKQDDDFHVVKDNESVWAGVNYSNSTQTFDINNTKVEVKAKGMFILKKKDDNTYECSFYNPESTNTASDIVSKISMTGYSITNKNTSTTNESGVRFELTK

SEQ ID NO: 34667 - protein, 250 aa, Staphylococcus aureus
  subsp. aureus 21262
MGEFEVKYLTGFILILLLEGIFTNSASAIEYSDLHHKSKLDSKGLYNAKVSFANPTELENKKTNDRLLKHDLLFHDMFVNDDWKKDFKVEFENEALSKKFINKDIDIFAGNYGYGCHGGATNKTQCSYGGVTLSDNNKYDDYKNIPCNLWIDGHQTEIKLTAVKTKKKIVTIQELDVQLRNYLNEKYKLYEQGGDIVKGYVKYHNDDEKNVEYDFYNLNGEYGHEVLKIYADNKTINSDKLHLDIYLFKS

SEQ ID NO: 34668 - protein, 291 aa, Staphylococcus aureus
  subsp. aureus 21262
MKKIEAWLSKKDLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 34669 - protein, 891 aa, Staphylococcus aureus
  subsp. aureus 21262
MNKHHPKLRSFYSIRKSTLGVASVIVSTLFLITSQHQAQAAENTNTSDKISENQNNNATTTQPPKDTNQTQPATQPANTAKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNISNQNTSTTNNTSDQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTKEVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYMPDKAVYNAIVKVVVANIGYEGQYHVRIINQDIKTKDEDTSQNNTSEPLNVQTGQEDKVSDTDIAENSSTATNPKDASDKADVIEPESDMVKDADNNIDKDVQHDVDHLSDMSDNNHFDKYDLKEMDTQIAKDTDKGVDNSVGMSSNVDTDKDSNKNKDKVIQLDHIADKNNHTGKAAKLDVVKQNYNNTDKVTDKKTTEHLPSDIHKTVDKTVKAKEKAGTPSKENKLSQSKMLPKTGETTSSQSWWGLYALLGMLALFIPKFKKESK

SEQ ID NO: 34670 - protein, 2185 aa, Staphylococcus aureus
  subsp. aureus 21262
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSVQNNNHTDGNTTATETVSNANNNDVVSNNTTLNVPNKTNENGSGGHLTLKEIQEDVRHSSDKPELVAIAEQASNRPKKRSRRAAPADPNATPADPAAAAANGTVPAGNTATYTPTTDPNANNAGQNAPNEVLSFDDNGIRPSTNRSVPSVTVVDNLPGFTLINGGKVGVFSHAMVRTSMFDSGDNKNYQAQGNVIALGRIHGTDTNDHGDFNGIEKTLTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRAMDPTATNNKEFTVTTSLKNNGNSGASLDTNDFVYQVQLPEGVEYVNNSLTKDFPSNNSGVDVNDMKVTYDAANRVITIKSTGGGTTNSPARLMPDKILDLKYKLRVNNVPTPRTVTFNDTLTYKTYTQDFINSPAESHTVSTNPYTIDIIMNKDALQGEVDRRIQQADYTFASLDIFNDLKRRAQTILDENRNNVPLNKRVSQADIDSLTNQMQHTLIRSVDAENAVNKKVDQMEDLVNQNDELTDEEKQAAIQIIEEHKNEIIGNIGDQTTDEGVTRIKDQGIQTLSGDTATPVVKPNAKKAIRDKAAKQREIINNTPDATQDEIQDALNQLATDETDAIDNVTNATTNDDVETAKNNGINTIGAVVPQVTHKQAARDAINQATATKRQQINNNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQAALDKINEFVNQAMTDITNNRTNQQVDDTTSQALDSIALVTPEHIVRAGARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRDTLDTTQDERDVAIDTLNKIVNTIKNDIAQNKTNAEVDRTETDGNDNIKVILPKVQVKPSARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNAAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNIQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKVIQSAPKVCTPIKKEEIHESRKVEKELPNTGSEGMDLPLKEFALITGAALLARRRTKNEKES

SEQ ID NO: 34671 - protein, 188 aa, Staphylococcus aureus
  subsp. aureus 21262
MRDKKGPVNKRVDFLSNKLNKYSIRKFTVGTASILIGSLMYLGTQQEAEAAENNIENPTTLKDNVQSKEVKIEEVTNKDTAPQGIEAKSEVTSNKDTIEHEPSVKAEDISKKEDTPKEVANVAEVQPKSSVTHNAETPKVRKARSVDEGSFDITRDSKNVVESTPITIKGKEHFEGYGSVDIQKTQQI

SEQ ID NO: 34672 - protein, 933 aa, Staphylococcus aureus
  subsp. aureus 21262
MIVVGMGQEKEAAASEQNNTTVEESGSSATESKASETQTTTNNVNTIDETQSYSATSTEQPSQSTQVTTEEAPTTVQAPKVETSRVDLPSEKVADKETTGTQVDTAQPSNISEIKPRMKRSADGAVVSEKEVVEEAKATGTDVTSKVKVEEGSEIVGHNNKETNVVNPHNAERVTLKYKWKFEDGIKPGDYFDFTLSNNVETHGISTLRKVPEIKSTDGQVMANGQVINERKIRYTFTDYINHKKDLTAELNLNLFIDPTTVTKQGKEKVEVSLGQNKISQEFDIQYLDGVKDRMGVTVNGRIDTLNKEDGKFSHFAYIKPNNRSLSSVTVTGQVTAGYKQNAKNPTVKVYKHIGSDELAESVYAKLDDASKFEDVTEKVNLSYTGEGGYSFTFDSLEDNNNYVVKYEGEYNTEAKDLNFQTRLTGYHNYYPYYPYYPVQLTWNNGVAFYSNKAQGDGKDKPKEPIIEHSTPIELEFKSEPPVEKHELTGTIEESDDSKPIDFEYHTAVEGSEGHAEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNRGNQSFEEDTEEDKPKYEQGGNIVDIDFDSVPQIQGQNNGNQSFEEDTEKDKPKYEQGGNIIDIDFDSVPHIHGFNKHNEIIEEDTNKDKPNYQFGGHNSVDFEEDTLPKVSGQNEGQQTIEEDTTPPTPPTPEVPSEPETPTPPTPEVPSEPGEPTPPTPEIPSEPDTPVPPTPEVPAEPGKPVPPAKEEPKKPSKPVEQGKVVTPVIEINGKVKAVTPTKQKQSKKYELPETGGEESTNKGMLFGGLFSILGLALLRRNKKNNKA

SEQ ID NO: 34673 - protein, 1008 aa, Staphylococcus aureus
  subsp. aureus 21262
MIVVGMGQDKEAAASEQKTTTVEENGNSATDNKVSETQTTTTNVNHIEETQSYNATVTEKPSNATQVTTEEAPKAVQAPQTAQPANVETVKEEVVKEEANPQVKETTQPQDNSGDQRQVDLTPKKATQNQVAETQVEVAQPRTASESKPRVTRSADVVEAKEASDAKVETGTDVTSKVTVEDESKIEAPKGNNVQPHEGQRVVLKYKLKFQDGLKTGDYFDFTLSNNVNTHGVSTTRKVPDIKNGSLVMAKGQVLDNGRIRYTFIDYIKDKVNVTANLEINLFIDPKTVQNNGQQTITSKLNGRETSGTMQITYKDGVKNQYTNVNGSIETFDKEKNKFTHVAYIKPINGNNSDSVTVTGMLTQGSNENGTQPNVKIYEYVGTENGLPQSVYANTVDSTQLKDVTNQMSDKLKVQNNGSYSLNFDKLDKTYVIHYTGDYLNGTSEVNFRTQLTGYPENHYKTYYYYNHGYTLTWDNGLVLYSNKANGDGKYGPIVDSNNFEFSEDSGNGSISGQYDEKQIIETEENQDNTPLDIDYHTAIDGEGGYVDGYIETIEETDSSAVDIDYHTAVDSEAGHVGGYTESSEESNPIDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPMYEQGGNIIDIDFDSVPQIHGFNKHNEIIEEDTNKDKPNYQFGGHNSVDFEEDTLPKVSGQNEGQQTIEEDTTSPTPPTPEVPSEPETPTPPTPEVPSEPETPTPPTPEVPSEPETPTPPTPEVPSEPGTSVPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 34674 - protein, 231 aa, Staphylococcus aureus
  subsp. aureus 21262
GYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34675 - protein, 434 aa, Staphylococcus aureus [sequence omitted]

SEQ ID NO: 34676 - protein, 203 aa, Staphylococcus aureus
  subsp. aureus 21262
MFKKYESKNSIVLKSILSLGIIYGGTFGIYPKADASTQNSSSVQDKQFQKVEEVPNNSEKALVKKLYDRYSQNTINGKSNKARNWVYSERPLNENQVRIHLEGTYTVAGRVYTPKRNITLNKEVVTLKELDHIIRFAHISYGLYMGEHLPKGNIVINTKNGGKYTLESHKELQKNRENVEINTADVENVTFDLVKSVNDIEQV

SEQ ID NO: 34677 - protein, 226 aa, Staphylococcus aureus
  subsp. aureus 21262
MKFKAIAKASLALGMLATGVITSNIQAVQAKTEVKQQSESELKHYYNKPILESKNVTGYGFTDKGQHYLEVTVGQQHSLITLLTSDKDKYNKDVNPNLDVFILREGDSRQATNYSIGGVTKTNSVQYIDYINTPILEVKKGKEEPQSSLYQIYKEDISLKELDFKLRKQLISQSGLYSNGLKQGQITITMNDGTTHTIDLSQKLEKERMGESIDGRQIQKILVEIK

SEQ ID NO: 34678 - protein, 231 aa, Staphylococcus aureus
  subsp. aureus 21262
MKMKKIAKISLLLGILATGVNTTTEKPVHAEKKPIVISENSKKLKAYYNQPSIEYKNVTGYISFIQPSIKFMNIIDGNSVNNIALIGKDKQHYYTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 34679 - protein, 369 aa, Staphylococcus aureus
  subsp. aureus 21262
MKMRTIAKTSLALGLLTTGAITVTTQSVKAEKVQSTKVDKVPTLKAERLAMINITAGANTATTQAANTRQERTPKLEKAPNTNEEKTSASKIEKISQPKQEAQKSLNISATPAPKQEQSQTTTESTTPKTKVTTPQSTNTPKTKVTTPQSTNTPQPMQSTKSDTPQSPTIKQAQTDMTPKYEDLRAYYTKPSFEFEKQFGFMLKPWTTVRFMNVIPNRFIYKIALVGKDEKKYKDGPYENIDVFIVLEDNKYQLKKYSVGGITKTNSKKVDHKAELSITQENNQGTISRDVSEYMITKEEISLKELDFKLRKQLIEKHNLYGNMGSGTIVIKMKNGGKYTFELHKKLQEHRMADVIEGTNIDKIEVNIK

SEQ ID NO: 34680 - protein, 313 aa, Staphylococcus aureus
  subsp. aureus 21262
MKITTIAKTSLALGLLTTGVITTTTQAANATTPPSTKVETPQQAANATTPSSTKVETPQQTPNATTPSSTKMETPQQTPNATTPSSTKVETPQQTPNAPTPPSTKVETPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDKKGTISHDVSEFKITKEQISLKELDFKLRKQLIENHNLYGNVGSGKIVIKMKNGGKYTFELHKKLQENRMADVIDGTNIDSIEVNIK

SEQ ID NO: 34681 - protein, 234 aa, Staphylococcus aureus
  subsp. aureus 21262
MKMTAIAKASLALGILATGTITSTHQTVNASEHEAKYENVTKDIFDLRDYYSGASKELKNVTGYRYNKGGKHYLIFDKNRKFTRVQIFGKDIERLKTRKNPGLDIFVVKEAENRNGTVFSYGGVTKKNQGAYYDYLNAPKFVIKKEVDAGVYTHVKRHYIYKEEVSLKELDFKLRQYLIQNFDLYKKFPKDSKIKVIMKDGGYYTFELNKKLQTNRMSDVIDGRNIEKIEANIR

SEQ ID NO: 34682 - protein, 232 aa, Staphylococcus aureus
  subsp. aureus 21262
MKLKTLAKATLVLGLLATGVITTESQTVKAAESTQGQHNYKSLKYYYSKPSLELINVDGLYRQHLTDKGAYVWKNLKDYYIGLLGEDSKKFKTDVYGDLDAFLVIEEEPVKGRQYSIGGISKTNSKEFKEREVDVKVTRKADKDTTSTKDSKFKITKEEISLKELDFKLRQKLMKEENLYDAVNNRKGKIVVKMEDDKFYTFELTKKLQPHRMGDTIDGTKIKEINVELEYK

SEQ ID NO: 34683 - protein, 231 aa, Staphylococcus aureus
  subsp. aureus 21262
MKLKTLAKATLALGLLTTGVITSEGQAVHAKEKQERVQHLYDIKDLHRYYSSESFEFSNISGKVENYNGSNVVRFNQKGQNHQLFLLGKDKEEYKEGIEGKDVFVVKELIDPNGRLSTVGGVTKKNNQSSETNIHLLVNKLDGGNLDATNDSFLINKEEVSLKELDFKIRKQLVEKYGLYQGTTKYGKITFNLKDGEKKEIDLGDKLQFERMGDVLNSKDINKIEVTLKQI

SEQ ID NO: 34684 - protein, 232 aa, Staphylococcus aureus
  subsp. aureus 21262
MKFTAIAKAIFVLGILTTSVMITENQSVNAKGKYEKMNRLYDTNKLHQYYSGPSYELTNVSGQSQGYYDSNVLLFNQHNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVISSEQIKNIEVNLK

SEQ ID NO: 34685 - protein, 871 aa, Staphylococcus aureus
  subsp. aureus 21262
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTTSGQNTYKQTVFVNPKQRVLGNTWVYIKGYQDKIEESSGKVSATDTKLRIFEVNDTSKLSDSYYADPNDSNLKEVTDQFKGKITYKYQNVASINFGDINKTYVVLVEGHYDKTGKNLKTQVIQENVDPATGKDYSIFGWNNENVVRYGGGSADGDSAVNPKDPTPGPPVDPEPSPEPEPEPTPDPEPSPDPDPEPTPDPDPDSDSDSDSGSDSDSGSDSDSGSDSDSGSDSDSDSDSNSDSDSESDSDSDSESDSDSESDSDSDSDSDSDSDSDSDSDSDSDSDSDSDSDSDSESDSDSESDSDSESDSDSESDSDSDSDSDSDSDSDSDSDSDSDSDSDSESDSDSDSDSDSDSDSDSDSDSDSESDSDSDSDSDLESDSDSESDSDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 34686 - protein, 198 aa, Staphylococcus aureus
  subsp. aureus 21262
MLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNVNGTTNNSAVNPSIKANDIHTKSNKQMAKQQSIHLDSKSKSVHKQQLKELPKTGVNNESNTAIMALFSGLILLVVSLVTRFIKLNSHQ

SEQ ID NO: 34687 - protein, 641 aa, Staphylococcus aureus
  subsp. aureus 21262
MNKQQKEFKSFYSIRKSSLGVASVAISTLLLLMSNGEAQAAEETGGTNTEAQPKTEAVASPSTTTEKAPEAKPVANAFSVSNKEVEAPTSETKEAKEVKAPKETKEVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAKPSKPTPSPVEKESQKQDSQKDDNTQSPSVEKENDASSESGKDKTPATKPAKAEVESSSTTPTKVVSTTQNVAKPTTASSETTKDVVQTSAGSSEAKDSAPLQKANIKNTNDRHTQSQNNKNTQENKAKSLPQTGEESNKDMTLPLMALLALSSIIAFVLPRKRKN

SEQ ID NO: 34688 - protein, 354 aa, Staphylococcus aureus
  subsp. aureus 21262
MTKHYLNSKYQSEQRSSAMKKITMGTASIILGSLVYIGADSQQVNAATEATNATNNQSAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKQNEVHKQGPSKDSKAKELPKTGLTSVDNFISTVAFATLALLGSLSLLLFNRKESK

SEQ ID NO: 34689 - protein, 105 aa, Staphylococcus aureus; identical to SEQ ID NO: 31317
  subsp. aureus 21262

SEQ ID NO: 34690 - protein, 165 aa, Staphylococcus aureus
  subsp. aureus 21262
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDVTIKKEQKLIQAQNLVREFEKTHTVSAHRKAQKAVNLVSFEYKVKKMVLQERIDNVLKQGFVK

SEQ ID NO: 34691 - protein, 319 aa, Staphylococcus aureus; identical to SEQ ID NO: 30495
  subsp. aureus 21262

SEQ ID NO: 34692 - protein, 352 aa, Staphylococcus aureus
  subsp. aureus 21262
DFAFGLSMTSKNVARYESINNENLKGWHTGAGMSYLYNSDVKHYRDNFWATADMKRLAGTTTLDNEILKDTDDKKSSKTFVGGTKFDDQHASIGMDFENQDKTLTAKKSYFILNDKIVFLGTGIKSTDSSKNPVTTVENRKANGYTLYTDDKQTTASNINDQETNSVFLESTNKPKNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSTTNESGVRFELTK

SEQ ID NO: 34693 - protein, 141 aa, Staphylococcus aureus
  subsp. aureus 21262
MKLKSFVTATLALGLLSSVGAALPSHEASADSNNGYKEMTMDGYHTVPYTISVDGITALHRTYFVFSENKKVLYQEIDSKVKNELASQRGVTTEKINNAQTATYTLTLNDGNKKVVNLKKNDDAKNSIDPSTIKQIQIVVK

SEQ ID NO: 34694 - protein, 233 aa, Staphylococcus aureus; identical to SEQ ID NO: 30678
  subsp. aureus 21262

SEQ ID NO: 34695 - protein, 683 aa, Staphylococcus aureus
  subsp. aureus 21262
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAEYTVYFKNGAKRVIDLKAGIYTADLINTSEIKAININVDTKKHIEDKKKDKANYQVPYTITVNGTSQNILSNLTFNKNQNISYKDLEDKVKSVLESNRGITDVDLRLSKQAKYTVNFKNGTKKVIDLKAGIYTANLINSSDIKSININVDTKKHVENKAKRNYQVPYSINLNGTSTNILSNLSFSNKPWKNYKDLTRQIKSVLKHDRGISEQDLKYAKKAYYTVYFKNGGKRILQLNSKNYTANLVHAKDVKRIEITVKTGPKAKADRYVPYTIAVNGTSTPILSKLKFSGDPRVGYSDITKKVKSVLKYDRGISDRELKFAKKATYTVHFKNGKKQVVDLNSNINQLNLLFVKDIKKIVVDVKTGPKAKAESYVPYTIAVNNTSTPILSKLKLSNKQLISYKYLNDKVKSVLKSERGISDLDLQFAKQAQYTVHFKNGKKQVVNLNSNIFTPNLFSAKDIKKIDINVKQHTKSKKNKSNNVKFPVTINKFENIVSNEFVFYNASKITINDLSIKLKSAMANDQGITKHDIGLAERAVYKVYFKNGLSKYVDLKTEYKDGKVFKATDIKKVDIELKF

SEQ ID NO: 34696 - protein, 260 aa, Staphylococcus aureus; identical to SEQ ID NO: 30625
  subsp. aureus 21262

SEQ ID NO: 34697 - protein, 274 aa, Staphylococcus aureus; identical to SEQ ID NO: 30872
  subsp. aureus 21262

SEQ ID NO: 34698 - protein, 338 aa, Staphylococcus aureus; identical to SEQ ID NO: 34423
  subsp. aureus 21262

SEQ ID NO: 34699 - protein, 351 aa, Staphylococcus aureus
  subsp. aureus 21262
MKNKKRVLIASSLSCAILLLSAATTQANSAHKDSQDQNKKEHVDKSQQKDKRNVTNKDKNSPVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 34700 - protein, 2448 aa, Staphylococcus aureus
  subsp. aureus 21262
MNLFRQQKFSIRKFNVGIFSALIATVTFISTNPTTASAAEQNQPAQNQPAQPADANTQPNANAGAQANPTAQPATPANQGQPAAQPASQGGQANPAGGAAQPNTQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNTTNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDTANSNSEVAIAKDNGIAAINQVQAATTKKSDAKAEIAQKASERKTAIEAMNDSTTEEQQAAKDKVDQAVVTANADIDNAAANADVDNAKTTNEATIAAITPDANVKPTAKQAIADKVQAQETAIDAAHSNAEVEAAKNAEIAKIEVIQPATTTKDDAKQAITTKANERKTAIAQTQDITAEEIAAANADVDNAVTQANSNIEAANSQNDVDQAKTTGEASIDQVTPTVNKKATARNEITTILNNKLQEIQATPDATDEEKQAADAEANTENGKANQAISAATTNAQVDEAKANAEAAINAVTPKVVKKQAAKDEIDQLQVAQTSVINNDQNATNEEKEAAIQQLATAVTDAKNNITAATDDNGVDTAKDAGKNSIQSTQPATAVKSNAKNEIDQAVTTQNQAIDNTTGATTEEKNAAKDLVLKAKEKAYQDILNAQTTNDVTQIKDQAVADVQGITADTTIKDVAKDELATKANEQKALIAQTADATTEEKEQANQQVDAQLTQGNQNIENAQSIDDVNTAKDNAIQAIDPIQASTDVKTNARGELLTEMQNKITEILNDNTTTNEEKGKDIEPVRAAYEEGLNNINAATTTGDVTTAKDTAVQKVQQLHANPVKKPAGKTDLDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVRIHNDLDNINDYTIPTGKKETATTDLYAYADQKKNNISADTNATQDEKQQAIKQVDQNVQTTLESINNGVDNGDVDDALTQGKAAIDAIQVDATVKPKANQAIEAKAEDTKESIDHSDQLTAEEKTEALAMIKQITDQAKKGITDATTTAEVEKAKVQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANATNSGSDNNDATANSNANATPENTGQPNVSETTDNGKADASPTTPNNSDAATGETTATDDANNKPTANNNSSVDASTDNSATGNGTTDKPEVESTNNGTTDKPATETDNATPAESTTNNNSTTATNENAPTGSTATAPTTNASTGAASSADSKDNASVNDSKQNAEVNNSAESQSTNGKVAQPKSENKAKAEKDGRDSTNQSMVESTTETLPSADITEPKVSSNTSKDKEESTTNQTDAEQHKSETNVASNEADKSSSKADTEVSNKTSTSASSEAKDKMTSTEDSQKADMATTDTNDTQKSVDSAANNKAKDMQTNDMKASLATVSNGSNSANQDMLNVTKTEENKANAKSAQQGKVNKPKQQAKTLPDTGMSHNDDLPYAELALGAGMAFLIRRFTKKDQQTEE

SEQ ID NO: 34701 - protein, 141 aa, Staphylococcus aureus; identical to SEQ ID NO: 31214
  subsp. aureus 21264

SEQ ID NO: 34702 - protein, 808 aa, Staphylococcus aureus; identical to SEQ ID NO: 31215
  subsp. aureus 21264

SEQ ID NO: 34703 - protein, 321 aa, Staphylococcus aureus; identical to SEQ ID NO: 31900
  subsp. aureus 21264

SEQ ID NO: 34704 - protein, 315 aa, Staphylococcus aureus; identical to SEQ ID NO: 31191
  subsp. aureus 21264

SEQ ID NO: 34705 - protein, 325 aa, Staphylococcus aureus
  subsp. aureus 21264
MNMNKLVKSSVATSMALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVKAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 34706 - protein, 942 aa, Staphylococcus aureus
  subsp. aureus 21264
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIERIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 34707 - protein, 233 aa, Staphylococcus aureus; identical to SEQ ID NO: 31039
  subsp. aureus 21264

SEQ ID NO: 34708 - protein, 879 aa, Staphylococcus aureus
  subsp. aureus 21264
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 34709 - protein, 1351 aa, Staphylococcus aureus; identical to SEQ ID NO: 31203
  subsp. aureus 21264

SEQ ID NO: 34710 - protein, 681 aa, Staphylococcus aureus
  subsp. aureus 21264
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34711 - protein, 62 aa, Staphylococcus aureus; identical to SEQ ID NO: 31886
  subsp. aureus 21264

SEQ ID NO: 34712 - protein, 167 aa, Staphylococcus aureus; identical to SEQ ID NO: 31885
  subsp. aureus 21264

SEQ ID NO: 34713 - protein, 291 aa, Staphylococcus aureus; identical to SEQ ID NO: 30390
  subsp. aureus 21264

SEQ ID NO: 34714 - protein, 278 aa, Staphylococcus aureus
  subsp. aureus 21264
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMS

SEQ ID NO: 34715 - protein, 2189 aa, Staphylococcus aureus; identical to SEQ ID NO: 31236
  subsp. aureus 21264

SEQ ID NO: 34716 - protein, 331 aa, Staphylococcus aureus; identical to SEQ ID NO: 31235
  subsp. aureus 21264

SEQ ID NO: 34717 - protein, 806 aa, Staphylococcus aureus; identical to SEQ ID NO: 31234
  subsp. aureus 21264

SEQ ID NO: 34718 - protein, 258 aa, Staphylococcus aureus; identical to SEQ ID NO: 30518
  subsp. aureus 21264

SEQ ID NO: 34719 - protein, 251 aa, Staphylococcus aureus; identical to SEQ ID NO: 30505
  subsp. aureus 21264

SEQ ID NO: 34720 - protein, 261 aa, Staphylococcus aureus; identical to SEQ ID NO: 30506
  subsp. aureus 21264

SEQ ID NO: 34721 - protein, 242 aa, Staphylococcus aureus; identical to SEQ ID NO: 30522
  subsp. aureus 21264

SEQ ID NO: 34722 - protein, 239 aa, Staphylococcus aureus; identical to SEQ ID NO: 30171
  subsp. aureus 21264

SEQ ID NO: 34723 - protein, 254 aa, Staphylococcus aureus; identical to SEQ ID NO: 31226
  subsp. aureus 21264

SEQ ID NO: 34724 - protein, 231 aa, Staphylococcus aureus; identical to SEQ ID NO: 31216
  subsp. aureus 21264

SEQ ID NO: 34725 - protein, 241 aa, Staphylococcus aureus; identical to SEQ ID NO: 31173
  subsp. aureus 21264

SEQ ID NO: 34726 - protein, 241 aa, Staphylococcus aureus; identical to SEQ ID NO: 31239
  subsp. aureus 21264

SEQ ID NO: 34727 - protein, 238 aa, Staphylococcus aureus; identical to SEQ ID NO: 31240
  subsp. aureus 21264

SEQ ID NO: 34728 - protein, 234 aa, Staphylococcus aureus; identical to SEQ ID NO: 30530
  subsp. aureus 21264

SEQ ID NO: 34729 - protein, 1017 aa, Staphylococcus aureus
  subsp. aureus 21264
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 34730 - protein, 434 aa, Staphylococcus aureus [sequence omitted]

SEQ ID NO: 34731 - protein, 516 aa, Staphylococcus aureus
  subsp. aureus 21264
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQTPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34732 - protein, 221 aa, Staphylococcus aureus; identical to SEQ ID NO: 31036
  subsp. aureus 21264

SEQ ID NO: 34733 - protein, 1137 aa, Staphylococcus aureus; identical to SEQ ID NO: 31254
  subsp. aureus 21264

SEQ ID NO: 34734 - protein, 1356 aa, Staphylococcus aureus
  subsp. aureus 21264
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 34735 - protein, 924 aa, Staphylococcus aureus
  subsp. aureus 21264
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDSDSDSDSDSDSDSDSDSDSDSDSDSDSDSDSESDSDSDSDSESDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 34736 - protein, 232 aa, Staphylococcus aureus; identical to SEQ ID NO: 31257
  subsp. aureus 21264

SEQ ID NO: 34737 - protein, 227 aa, Staphylococcus aureus; identical to SEQ ID NO: 30564
  subsp. aureus 21264

SEQ ID NO: 34738 - protein, 232 aa, Staphylococcus aureus; identical to SEQ ID NO: 30565
  subsp. aureus 21264

SEQ ID NO: 34739 - protein, 231 aa, Staphylococcus aureus; identical to SEQ ID NO: 30566
  subsp. aureus 21264

SEQ ID NO: 34740 - protein, 234 aa, Staphylococcus aureus; identical to SEQ ID NO: 30567
  subsp. aureus 21264

SEQ ID NO: 34741 - protein, 325 aa, Staphylococcus aureus; identical to SEQ ID NO: 33964
  subsp. aureus 21264

SEQ ID NO: 34742 - protein, 343 aa, Staphylococcus aureus; identical to SEQ ID NO: 31263
  subsp. aureus 21264

SEQ ID NO: 34743 - protein, 233 aa, Staphylococcus aureus; identical to SEQ ID NO: 31264
  subsp. aureus 21264

SEQ ID NO: 34744 - protein, 226 aa, Staphylococcus aureus; identical to SEQ ID NO: 31265
  subsp. aureus 21264

SEQ ID NO: 34745 - protein, 691 aa, Staphylococcus aureus; identical to SEQ ID NO: 31040
  subsp. aureus 21264

SEQ ID NO: 34746 - protein, 652 aa, Staphylococcus aureus
  subsp. aureus 21264
MNKQQKEFKSFYSIRKSSLGVASVAISTLLLLMSNGEAKAAEETGVTNTEAQPKTEAVASPTTTTTEKAPEAKPVAKPVANAVSVSNKEVVAPTTETKEAKEVKAVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAMPSKPTTPPVEKESQKQDSQKDDNKQSPSVEKENDASSESGKDKMPVTKPAKAEVESSSTTPTKVVSTTQNVAKPTTASSETTKDVVQTSAGSSEAKDSAPLQKANIKNTNDGHTQSQNNKNTQENKAKSLPQTGEESNKDMTLPLMALIALSSIVAFVLPRKRKN

SEQ ID NO: 34747 - protein, 354 aa, Staphylococcus aureus; identical to SEQ ID NO: 30412
  subsp. aureus 21264

SEQ ID NO: 34748 - protein, 105 aa, Staphylococcus aureus; identical to SEQ ID NO: 31168
  subsp. aureus 21264

SEQ ID NO: 34749 - protein, 165 aa, Staphylococcus aureus; identical to SEQ ID NO: 31241
  subsp. aureus 21264

SEQ ID NO: 34750 - protein, 206 aa, Staphylococcus aureus
  subsp. aureus 21264
MQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKATKQQTNIDVIYERVRDDYQLHWTSTNWKGTNTKDKWTDRSSERYKIDWEKEEMTN

SEQ ID NO: 34751 - protein, 112 aa, Staphylococcus aureus
  subsp. aureus 21264
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKV

SEQ ID NO: 34752 - protein, 689 aa, Staphylococcus aureus; identical to SEQ ID NO: 31861
  subsp. aureus 21264

SEQ ID NO: 34753 - protein, 257 aa, Staphylococcus aureus; identical to SEQ ID NO: 31220
  subsp. aureus 21264

SEQ ID NO: 34754 - protein, 280 aa, Staphylococcus aureus
  subsp. aureus 21264
MLQGFYVSKLGGQYKRAYLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34755 - protein, 339 aa, Staphylococcus aureus; identical to SEQ ID NO: 31219
  subsp. aureus 21264

SEQ ID NO: 34756 - protein, 351 aa, Staphylococcus aureus; identical to SEQ ID NO: 31218
  subsp. aureus 21264

SEQ ID NO: 34757 - protein, 372 aa, Staphylococcus aureus; identical to SEQ ID NO: 33950
  subsp. aureus 21264

SEQ ID NO: 34758 - protein, 143 aa, Staphylococcus aureus
  subsp. aureus 21266
DLDSDSDSDSDSDSDSDSDSDSDSDSDSDSDSDSDSDSDSDSDSDSDSDSESDSDSDSDSDSDSDSDSDSRVTPPNNEQKAPSNHKGEVNHSNKVSKQHKTDALPETGDKSENTNATLFGAMMALLGSLLLFRKRKQDHKEKA

SEQ ID NO: 34759 - protein, 231 aa, Staphylococcus aureus; identical to SEQ ID NO: 33623
  subsp. aureus 21266

SEQ ID NO: 34760 - protein, 327 aa, Staphylococcus aureus
  subsp. aureus 21266
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSLNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 34761 - protein, 311 aa, Staphylococcus aureus; identical to SEQ ID NO: 30617
  subsp. aureus 21266

SEQ ID NO: 34762 - protein, 168 aa, Staphylococcus aureus
  subsp. aureus 21266
LDIPQTGDKDLPPGTNFEIPKDRVPEGWTVTVDPDGKVSVTPPADVTPGTEVDIPVKVTYPDGSTEETSVKVIIISDDSDSDADSDSDSDSDSDSDADSDSDSDSDSDSRKHTSVKPMSVTKDHHNKAKALPETGSGNDESNNGTLFGGLFAALGSLLLFGRRKKQNK

SEQ ID NO: 34763 - protein, 233 aa, Staphylococcus aureus; identical to SEQ ID NO: 30428
  subsp. aureus 21266

SEQ ID NO: 34764 - protein, 198 aa, Staphylococcus aureus; identical to SEQ ID NO: 31544
  subsp. aureus 21266

SEQ ID NO: 34765 - protein, 178 aa, Staphylococcus aureus
  subsp. aureus 21266
MRKKSGPINKRVDFLSNRLNKYSIRKFTIGTASILVGSTLIFGIGSGEAKADEKVYTNNENGTKSKHEKSEVESAPEAKATESVQETNKVESAPEAKATESVQETNKVESAPEAKATENVQETNKVESAQQQDKGKSVEANEKSFYDLSKKIDQAVNKKEVVEKQVKKQFSSVLSEKK

SEQ ID NO: 34766 - protein, 912 aa, Staphylococcus aureus
  subsp. aureus 21266
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVALVAGEAKATGTDVTSKVKVTESSLEGHKQGTSVVNPHNAERVTLKYKWKFGEDIKPGDYFDFTLSNNVETHGISTLRKVPEIKSTDGQVMANGQVINERTIRYTFTDYINGKQNLTAELSLNLFIDPTTVTKKGKQKVEVSLGQNKISQEFDIQYLDGVKNPMGVTVNGRIHTLNKEEGKFSHFAYVKPNNQSLSSVTVTGQVTSGYKQDGGNPTVKVYKYTGKEGLAESVFADLSKNDQYEDITSQLSISYNNGGYTINFESLNNNKDYVIKYEGAYDAKSESLQLQTHLSAYNDYYYYPYYPVQLTWKNGVAFYSNNAQGDGKDKPNDPIIEKSEPIDLDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPKEHGQAQGPIEEITENYQHISHSGLGTENGHGNYGVIEEIEENSHVDIKSELGYEGGQNSGNQSFEEDTEEDKPKYEQGGNIVDIDFDSVPQIHGQNNGDQSFEEDTEKDKPKYEQGGNIIDIDFDSVPHIHGFNKHNEIIEEDTNKDKPNYQFGGHNSVDFEEDTLPQVSGHNEGQQTIEEDTTPPIVPPTPPTPEVPIVPPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 34767 - protein, 1012 aa, Staphylococcus aureus
  subsp. aureus 21266
MIVVGMGQDKEAAASEQKTTTVEENGNSATDNKVNETQTTTTNVNTIDETQSYSATATEQPSNATQVTTEKAPKAVQAVQAPQTAQPANLETVKEEVVKEEAKPQVKETTQSQDNSGDQRQVDLTPKKATQNQVAETQVEVAQPRTVSESKPRVTRSADVAEAKEASDVSEVKGTDVTSKVTVTESSIEGHNNTNKVEPHAGQRAVLKYKLKFENGLHQGDYFDFTLSNNVNTHGVSTVRKVPDILNGSLVMATGKVLGEGKIRYTFTDYINNKVNVTANLEINLFIDPKTVQDNGNQKITSMINDHETEKTIPISYNPGVSNTYANINGSIETFNKADNKFTHVAYIIPKNGMSTESATITGTLMKGSNSNGNSPTVKIFEVLESNKELPKSVYANINDTNTFKDVTSQMKDNLTVSENGSYSLNIENLNKTYVVHYSGEYLSGSHEVDFRTQMTGHPKQQSIYYYNHGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNIVDFEEDTLPKVSGQNEGQQTIEEDTTPPTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 34768 - protein, 650 aa, Staphylococcus aureus
  subsp. aureus 21266
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTDQFKNRIYYEHPNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPDPEPSPDPEPSPDPDPDSDSDSDSGSDSDSGSDSDSESDSDSDSDSESDSDSDSDSDSDSESDSDSDSDSESDSDS

SEQ ID NO: 34769 - protein, 2275 aa, Staphylococcus aureus
  subsp. aureus 21266
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSIASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGVVTLTQDTTSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTMEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVDSQSVSSSMSGSVSKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSISGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESISESTSESVSSSTSASTSLSDSTSESGSTSTSLSNSTSGSASISTSTSNSESTSTSKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSMSRSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSVSDSTSLSDSVSDSTSDSTSMSISDSMSVSVSLSDSTSTSTSASEVMSASISDSQSMSESVNDSESESESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISVSTSLSDSSSTSTSESLSDSMSQSQSTSTSASGSLSTSISTSMSMSASTSTSQSTSVSTSLSTSDSISDSTSISIRGSQSTVESESTSDSTSISDSESLSTSGSDSTSTSTSDSTSGSTSTSTSESLSTSGSGSTSVSDSTSMSESDSTSDSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTSAQSEKRLPDTGDSIKQNGLLGGVMTLLVGLGLMKRKKKKDENDQDDSQA

SEQ ID NO: 34770 - protein, 681 aa, Staphylococcus aureus
  subsp. aureus 21266
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSLTKEAPSLNKSDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 34771 - protein, 996 aa, Staphylococcus aureus
  subsp. aureus 21266
MNKNVLKFMVFIMLLNIITPLFNKNEALAARDISSTNVTDLTVSPTKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGQSAISDFEKAFPGSKITVDNTKNTIDVTIPQGYGSYNSFSINYKTKITNEQQKEFVNNSQAWYQEYGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVNTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTLPDEPSKVDKDDQPKDNKTKPENPLKELPKTGMKIITSWITWVFIGILGLYLILRKRFNS

SEQ ID NO: 34772 - protein, 259 aa, Staphylococcus aureus; identical to SEQ ID NO: 33363
  subsp. aureus 21266

SEQ ID NO: 34773 - protein, 426 aa, Staphylococcus aureus
  subsp. aureus 21266
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLAEAKKLNESQAPKADNNFNKEQQNAFYEILHLPNLTEEQRNGFIQSLKDDPSVSKEILAEAKKLNDAQAPKEEDNNKPGKEDGNKPGKEDNNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34774 - protein, 241 aa, Staphylococcus aureus; identical to SEQ ID NO: 31350
  subsp. aureus 21266

SEQ ID NO: 34775 - protein, 816 aa, Staphylococcus aureus
  subsp. aureus 21266
MTYRMKKWQKLSTITLLMAGAITLNGGEFRSIDKNQIAVADTNVQTTDYEKLRNTWLNVNYGYNQYDENNDAMKKKFEATEKEATNLLSSMKTESDRKYLWENSKDLDTKSADMTRTYRNIEKIAEAMKHKNTLLNTPDNNKKVKDAVEWLHKNAYGKEPDKKVADLKTNFSKSAPQKNTNLNWWDYEIGTPKSLTNTLILLNDQFSNEEKKKFTAPIKTFAPDSDKILSSVGKAEPAKGGNLVDISKVKLLESIIEEDKDMTKNSIDSFNKVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSASATVMKSLLRLSDAMDESTKAKYKKIVKSSVESDSSYKQNDYLNSYSDIDKMKSLMDDSTISTNGLTQQLKIYNDMDRVTYHNKDLDFAFGLSMTSKNVARYESINNENLKGWHTGAGMSYLYNSDVKHYRDNFWTTADMKRLAGTTTLENEVLKDTDDKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNKSKISIKKETHTGNWKEINKSQKDTRKTDEYYEVTQKHSNSDNKYGYVLYPGLSKDDFKTKKDEVTVVKQEDDFHVVKDNESVWAGVNYSDSTKTFEINGTKVEVKAKGMFILKKKDDNTYECSFYNPESTNSTSDIESKISMTGYSITNKNTSTSNESGVRFELQQTLNKDDN

SEQ ID NO: 34776 - protein, 141 aa, Staphylococcus aureus; identical to SEQ ID NO: 30524
  subsp. aureus 21266

SEQ ID NO: 34777 - protein, 250 aa, Staphylococcus aureus; identical to SEQ ID NO: 31910
  subsp. aureus 21266

SEQ ID NO: 34778 - protein, 291 aa, Staphylococcus aureus; identical to SEQ ID NO: 30390
  subsp. aureus 21266

SEQ ID NO: 34779 - protein, 895 aa, Staphylococcus aureus
  subsp. aureus 21266
MNNHHPKLRSFYSIRKSTLGVASVIVSTLFLITSQHQAQAAENTNTSDKISENQNNNATTTQQPKDTNQTQPATQPVNTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKGSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 34780 - protein, 1406 aa, Staphylococcus aureus
  subsp. aureus 21266
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSTVNQATPTSVQSSTPSAQNNNHTDGNTTATEIVSNANNNDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPTVNVVNNLPGFTLINVGKVGVFSHAMVRTSMFDSGDNKNYQAQGNVIALGRILGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSPAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGVTREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKKKHLQLLTKLKRIVR

SEQ ID NO: 34781 - protein, 331 aa, Staphylococcus aureus
  subsp. aureus 21266
MSNQFKSEEERRQWEQFQAFQNQQNQQNQQYGQKKSKKGWFWGCGGCLVLFILIIIGISACTAGITGNLGGNSSKETNKTHKIGETVKNGDLEITVNSVETMKSVGPSLAPTNAKGTFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKSKKDKQDTEVAVASSNSDNVNYEASATTPATTSSADTDSEDSEKSSKDEDKQNASKSDKDSVEKSESNEETAPVEPMPQSKPTTSEAPPSQNIHNEDNMYDASTE

SEQ ID NO: 34782 - protein, 303 aa, Staphylococcus aureus
  subsp. aureus 21266
SDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSDSDSDSDSDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 34783 - protein, 2552 aa, Staphylococcus aureus
  subsp. aureus 21266
MNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLIVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIQPKDYVVFIPPVGKQIRAVVYYNKVVASNMSNAVTILPDDIPPTINNPVGINAKYYRGDEVSFTMGVSDRHSGLKSTTITTLPSGWTSNLTKSDNKNGSLAITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKSEYQTANAAKTATVTIAKGQSFNIGDIKQYFTLSNGQAIPSGTFTNITSDRTIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKTQAEAGGRPNFRTTGYSQSNATTDGQRQFTLNGQVIQVLDIINPSNGYGGQPVTNSNTRANHSNSTVVNVNEPAANGASAFIIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTAIINSLTFTSNAPNRNYATASANEITSKTVSNVSRTGNNANVTVTVTYQDGTTSTVTVPVKHVIPEIVAHSHYTVQGQDFPAGNGSSASDYFKLSNGSAIPDATITWVSGQAPNKDNTRIGQDINVTAHILIDGETTPITKTATYKVVSTVPKHVFETNRGAVFPGVSDVYDAKQYVKPVNDSWTQNAQRMNFQFTNSYGPSKDVVGISTRDIRVTYDNHQTQIIKILAKVKPDPPRIDGNSVTYKAGLTNQQIKINNVLSSSSIKLFKADNTPLTITNTTYGSGNTAVVTVSDALPNGVIKARSSITMNNVTYTTQDEHGRAIDVTRNESVDSNDSATVTVTPQLQATTEGAVFIKGGDGFDFGHVERFIQNPPHGATVAWHDSPDTWKNTVGNTHKTAVVTLPSGQGTRNVEVPVKVYPVANAKAPSRDVKGQNLTNGTDAINYITFDPNTNTNGITAAWANRQQPNNQQAGVQHLNVDVTYPGISAAKRVPVTLNVYQFEFPQTIYTTTVGGTLASGTQASGYAQMQNATGLPTDGFTYKWNNAATGTNDANWAAMNKPNAAKVINAKYDVIYNGHTFASSLPAKFVVKDVQPAKPTVTETAAGAITIAPGANQTVNTHAGNVTTYADKLVIKRNGNVVTTFTRRNNTSPWVKEASAANVTGIVGTNNGITVAAGTFNPSDTIQVVATQGSGETISDEQRSDDFTVVAPQPNQATTKIWQNGHIDITPNNPSGHLINPTQVMDIAYTEKVGNGAEHSKTLNVVRGQNNQWTIANKPDYVTLDAHTGKVTFNANTIKPNSAITITPKAGTGHSASSNPSTLTAPAAHTVNTTEIVKDYGSNVTAAEINNAVQVANKRTATIKNGTAMPTNLAGGSTTTIPVTVTYNDGSTEEVQESIFTKADKRELITAKNHLDDPVSTDGKKPGTITQYNNAMHNA

SEQ ID NO: 34784 - protein, 372 aa, Staphylococcus aureus; identical to SEQ ID NO: 30609
  subsp. aureus 21266

SEQ ID NO: 34785 - protein, 241 aa, Staphylococcus aureus; identical to SEQ ID NO: 31311
  subsp. aureus 21266

SEQ ID NO: 34786 - protein, 241 aa, Staphylococcus aureus; identical to SEQ ID NO: 30739
  subsp. aureus 21266

SEQ ID NO: 34787 - protein, 238 aa, Staphylococcus aureus; identical to SEQ ID NO: 31313
  subsp. aureus 21266

SEQ ID NO: 34788 - protein, 319 aa, Staphylococcus aureus; identical to SEQ ID NO: 30741
  subsp. aureus 21266

SEQ ID NO: 34789 - protein, 165 aa, Staphylococcus aureus
  subsp. aureus 21266
MKNKLIAKSLLTLAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVR

SEQ ID NO: 34790 - protein, 109 aa, Staphylococcus aureus; identical to SEQ ID NO: 30603
  subsp. aureus 21266

SEQ ID NO: 34791 - protein, 350 aa, Staphylococcus aureus; identical to SEQ ID NO: 33885
  subsp. aureus 21266

SEQ ID NO: 34792 - protein, 641 aa, Staphylococcus aureus
  subsp. aureus 21266
MNKQQKEFKSFYSIRKSSLGVASVAISTLLLLMSNGEAQAAEETGGTNTEAQPKTEAVASPTTTTEKAPEAKPVANAVSVSNKEVEAPTSETKEAKEVKAPKETKAVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVRVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 34793 - protein, 266 aa, Staphylococcus aureus; identical to SEQ ID NO: 30401
  subsp. aureus 21266

SEQ ID NO: 34794 - protein, 225 aa, Staphylococcus aureus; identical to SEQ ID NO: 30763
  subsp. aureus 21266

SEQ ID NO: 34795 - protein, 321 aa, Staphylococcus aureus; identical to SEQ ID NO: 30959
  subsp. aureus 21266

SEQ ID NO: 34796 - protein, 315 aa, Staphylococcus aureus; identical to SEQ ID NO: 30573
  subsp. aureus 21266

SEQ ID NO: 34797 - protein, 325 aa, Staphylococcus aureus; identical to SEQ ID NO: 30407
  subsp. aureus 21266

SEQ ID NO: 34798 - protein, 943 aa, Staphylococcus aureus
  subsp. aureus 21266
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSGSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34799 - protein, 1777 aa, Staphylococcus aureus
  subsp. aureus 21266
MNLFRQQKFSIRKFNVGIFSALIATVTFISTNPTTASAAEQNQPAQNQPAQPADANTQPNANAGAQANPAAQPAAPANQGQPAAQPANQGGQANPAGGAAQPNTQPAGQGNQADPNNAAQAQPGNQAAPANQAGQGNNQATPNNNATPANQTQPANAPAAVQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADTSRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNDVKQAATARKTQNATVSNATNEEVAEADAAVDAAQKQGLHDIQVVKSKQEVADTKSKVLDKINAIQTQAKVKPAADTEVENAYNTRKQEIQNSNASTTEEKQAAYTELDAKKQEARTNLDAANTNSDVTTAKDNGIAAINQVQAATTKKSDAKAEIAQKASERKTAIEAMNDSTTEEQQAAKDKVDQVVVTANADIDNAAANADVDNAKTTNEATIAAITPDANVKPTAKQAIADKVQAQETAIDANNGSTTEEKTAAKQQVQTEKTTADAAIDAAHTNAEVEAAKNAEIAKIEAIQPATTTKDNAKEAIATKANERKTAIAQTQDITAEEIAAANADVDNAVTQANNNIEAANSQNDVDQAKTTGETSIDQVTPTVNKKATARNEITTILNNKLQAIQATPDATNEEKQAADAEANTENGKAIQAIAAATTNADVDEAKANAEAAINAVTPKVVKKQAAKDEIDQLQATQTNVINNDQNATNEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKKQLQQIYMLMQIKRK

SEQ ID NO: 34800 - protein, 609 aa, Staphylococcus aureus
  subsp. aureus 21266
MNMKKKEKHAIRKKSIGVASVLVGTLIGFGLLSSKEADASENSVTQSDSASNESKSNDPSSVNAAPKTDNTNVSDTKTSSNTNNGETSVAQNPAQQETTQSSLTNATTEETPVTGEATTATNQANTPATTQSSNTNAEELVNQTSNETTSNDTNTVSSVNSPQNSTNAENVSTTQDTSTEATPSNNESAPQSTDASNKDLVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSASDSDSASDSDSASDSDSASDSDSASDSDSASDSDSA

SEQ ID NO: 34801 - protein, 434 aa, Staphylococcus aureus [sequence omitted]

SEQ ID NO: 34802 - protein, 350 aa, Staphylococcus aureus; identical to SEQ ID NO: 34016
  subsp. aureus 21266

SEQ ID NO: 34803 - protein, 338 aa, Staphylococcus aureus
  subsp. aureus 21266
MIKQLCKNITICTLALSTTFTVLPATSFAKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 34804 - protein, 274 aa, Staphylococcus aureus; identical to SEQ ID NO: 30872
  subsp. aureus 21266

SEQ ID NO: 34805 - protein, 222 aa, Staphylococcus aureus
  subsp. aureus 21266
MQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELELQSRHYLHETYNLYNTDAFNGKIQRGLIEFHPSSGDSVGYDLFGAQGQYPDTQLRIYRDNKTIKSKNMHIDIYLYTT

SEQ ID NO: 34806 - protein, 96 aa, Staphylococcus aureus; identical to SEQ ID NO: 30813
  subsp. aureus 21266

SEQ ID NO: 34807 - protein, 227 aa, Staphylococcus aureus
  subsp. aureus 21266
MKFTALAKATLALGILTIGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 34808 - protein, 232 aa, Staphylococcus aureus
  subsp. aureus 21266
MKFTALAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKHGFSINELFFIQKEEVSLKELDFKIRKMLVEKYRLYKGASDKGRIVINMKDEKKYVIDLSEKLSFDRMFDVMDSKQIKNIEVNLN

SEQ ID NO: 34809 - protein, 232 aa, Staphylococcus aureus
  subsp. aureus 21266
MKLTGIAKAIFVLGILTTSVMITENQSVNAKGKYEKMNRLYDTNKLHQYYSGPSYELTNVSGQSQGYYDSNVLLFNQQNQKFKVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVISSEQIKNIEVNLK

SEQ ID NO: 34810 - protein, 231 aa, Staphylococcus aureus
  subsp. aureus 21266
MKLKTLAKATLALGLLTTGVITSEGQAVHAKEKQERVQHLYDIKDLYRYYSSESFEFSNISDKVENYNGSNVVRFNQEKQNHQLFLLGKDKDKYKKGLEGQNVFVVKELIDPNGRLSTVGGVTKKNNKSSETNTHLFVNKVYGGNLDASIDSFLINKEEVSLKELDFKIRKQLVEKYGLYKGTTKYGKITINLKDEKKEVIDLGDKLQFERMGDVLNSKDIQNIAVTINQI

SEQ ID NO: 34811 - protein, 234 aa, Staphylococcus aureus
  subsp. aureus 21266
MKMAAIAKASLALGILATGTITSLHQTVNASEHEAKYENVTKDIFDLRDYYSGASKELKNVTGYRYSKGGKHYLIFDKHQKFTRIQIFGKDIERSKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 34812 - protein, 308 aa, Staphylococcus aureus
  subsp. aureus 21266
MKITTIAKTSLALGLLTTGVITTTTQAANATTPSSTKVEAPQSTPPSTKVEAPQSKPNATTPPSTKVETPQQTPNATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 34813 - protein, 356 aa, Staphylococcus aureus
  subsp. aureus 21266
MKMRTIAKTSLALGILTTGAITVTTQSVKAEKVQSTKVDKVSTLKAERLAMINITAGANTVTTQAANTRQERTPKLEKAPNTNEEKTSTSKIEKISQPKQETQKSLNISTTPAPKQEQSQTTTESTTPKTKVTTPPSTNTPQPMQSTKSDTPQSPTIKQAQTDITPKYEGLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSITKKDNQGMISRDVSEYMITKEEISLKELDFKLRKQLIEKHDLYGNMGSGTIVIKMKNGGKYTFELHKKLQEHRMADVIEGTNIDKIEVNIK

SEQ ID NO: 34814 - protein, 231 aa, Staphylococcus aureus; identical to SEQ ID NO: 30578
  subsp. aureus 21266

SEQ ID NO: 34815 - protein, 226 aa, Staphylococcus aureus; identical to SEQ ID NO: 33588
  subsp. aureus 21266

SEQ ID NO: 34816 - protein, 203 aa, Staphylococcus aureus; identical to SEQ ID NO: 30770
  subsp. aureus 21266

SEQ ID NO: 34817 - protein, 691 aa, Staphylococcus aureus; identical to SEQ ID NO: 33577
  subsp. aureus 21266

SEQ ID NO: 34818 - protein, 1773 aa, Staphylococcus aureus
  subsp. aureus 21269
MNLFRQQKFSIRKFNVGIFSALIATVTFISTNPTTASAAEQNQPAQNQPAQPADANTQPNANAGAQANPTAQPAAPANQGQPAAQPANQGGQANPAGGAAQPNTQPAGQGNQADPNNAAQAQPGNQAAPANQAGQGNNQATPNNNATPANQTQPANAPAAAQPAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQAAIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINTAKVSGVKAIEATTTAQDLERVKNEEISKIENITDSTQTKMDAYNDVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANTDIDNAAANTDVDNAKTTNEATIAAITPDANVKPTAKQAIADKVQAQETAIDAYNGATTEEKAAAKQQVQTEKTTADAAIDGAHSNAEVEAAKNAEIAKIEAIQPATTTKDDAKQAITTKANERKAAIAQTQDITAEEIAAANADVDNAVTQANSNIEAANSQNDVDQAKTTGETSIDQVTPTVNKKAIARNEITTILNNKLQAIQATPDATDEEKQAADAEANTENGKANQAISAATTNAQVDEAKANAEVAINAVTPKVVKKQAAKDEIDQLQVAQTSVINNDQNATNEEKEAAIQQLATAVTDAKNNITAATDDNGVDQAKDAGKNSIQSTQPATAVKSNAKNEVDQAVTTQNQAIDNTTGATTEEKNAAKDLVLKAKEKAYQDILNAQTTNDVTQIKDQAVADVQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDATLNQAKTNVDQSSTNEYVDNAVKEGKAKINAVKTFSEYKKDALAKIEAAYNSKVNEADNSNASTSSEIAEAKQKLAELKQTADQNVNQATSKDDIEVQIHNDLDNINDYTIPTGKKKQLQQIYMLMQIKRK

SEQ ID NO: 34819 - protein, 993 aa, Staphylococcus aureus
  subsp. aureus 21269
MINRDNKKAITKKGMISNRLNKFSIRKYTVGTASILVGTTLIFGLGNQEAKAAENTSTENAKQDDATTSDNKEVVSETENNSTTENNSTNPIKKEKNTDSQPEDKEESTTSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRVNAKMRFAVAQPAAVASNNVNDLITVTKQTITEGIKDDGLIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSD

SEQ ID NO: 34820 - protein, 1306 aa, Staphylococcus aureus
  subsp. aureus 21269
MGTASILVGTTLIFGLGSQEAKAAEVTNKEMKEDATSVNNDQVSKKVDTEQLNNDGNTSKVDTEQLKDENINKVANQKEVTRVENSVASEKNNNSKPSENGKLQTSDVKKTEDNNATSDDQVTTTVNSQQLNTDNTTSMSSAPINVRKDDLKFNNEEVRNVGEKSDNTDNANSSELIKPKTTEPKRLNTRMRIAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVDKKDVPFSVTIGNQTTTTTADITYPAYKEADNNSIGSAFTETVSHAGNAEDPGYYNQVVYVNPMDKDLKGANLKVEAYHPKYPANIGQINQNVTNIKIYRVPEGYTLNKGYDVNANDLVDVTDEFKNKMAYGTNQSVNIDFGDITSAYVVMVKTKFQYTNSESPTLVQMATLTSDGNRSVSTGNALGFTNNQSGGAGQEVYKIGNYVWEDTNKNGVQELGEVGVKGVTVVAYDNKTNKEVGRTITDEKGGYLIPNLPNGDYRVEFSNLPQGYEVTPSKQGNNEELDSNGVSSVITVNGKDNLSADLGIYKPKYNLGDYVWEDINKNGIQDQDEKGISGVTVTLKDENGNVLKTVTTDADGKYKFTDLDNGNYKVEFTTPEGYTPTSTNTGGNDTVDSNGLTTTGVINGADNMTLDSGFYKTPKYNLGNYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKGVKVTLLNEKGEVIGTTKTDENGKYRFDNLDSGKYKVIFEKPAGLTQTGTNTTEDDKDADGGEVDVTITDHDDFTLDNGYFEEETSDSDSDSDSNSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDAGKHTPVKPMSTTKDHHNKAKALPETGSENNGSNNATLFGGLFAALGSLLLFGRRKKQNK

SEQ ID NO: 34821 - protein, 968 aa, Staphylococcus aureus
  subsp. aureus 21269
MNNKKTATNRKGMIPNRLNKFSIRKYSVGNASILVGTTLIFGLSGHEAKAAEHTNGELNQSKNETTAPSENKTTEKVDSRQQNNIEQSTTSDQPKVNESDNTSVKETTEEPQNTTSTQPTKQNNDATANKDNLAAQNISTQAKNVSTTPKTTNIKPRTLNRMAVNTVAAPQQGTNVNDKVHFSNIDIAIDKGHVNKDTGKTEFWATSSDVLKLKANYTIDDSVKEGDTFTFKYGQYFRPGSVRLPSQTQNLYNAQGNIIAKGIYDSNTNTTTYTFTNYVDQYTNISGSFEQVAFAKRENATTDKTAYPMEVTLGNDKYSKDVIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYYEEETSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSESDSDSDSDSDSDSDSGSDSDSDSESDSDSDSDSDSDSDSGSDSDSDSDSDSDSDSDSDSDSDSDAGKHTPAKPMSAVKDHHNKAKALPETGSENNGSNNATLFGGLFAALGSLLLFGRRKKQNK

SEQ ID NO: 34822 - protein, 893 aa, Staphylococcus aureus
  subsp. aureus 21269
MNKHHPKLRSFYSIRKSTLGVASVIVSTLFLITSQHQAQAAENTNTSDKISENQNNNATTTQPPKDTNQTQPATQPANTAKNYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDEPETNYDYTKLVFAKPIYNDPSLVKSDTNDAVTTNDQSSSDASNQTNTNTSNQNTSTTNNANNQPQATTDMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYIPDKAVYNAIVKVVVANIGYEGQYHVRIINQDIKTKDDDTSQNNTSEPLNVQTGQEDNVTATDTATNNSIETTPSEATDKVDLIEPESDMVKDTDSSVDKDAHHDVDHLSDMSGNTHFDKYDLKEMDTQIAKDTDKGVDNSVGMSSYVDTDKDSNKNKDKVIQLDHITDKNKVNNTGTETNIDTMKYHPISTIKVTDKKTTEHLPSDIHKTVDKTVKTKEKAGTPSKENKLSQSKMLPKTGETTSSQSWWSLYALLGMLALFIPKFRKESK

SEQ ID NO: 34823 - protein, 299 aa, Staphylococcus aureus; identical to SEQ ID NO: 33223
  subsp. aureus 21269

SEQ ID NO: 34824 - protein, 254 aa, Staphylococcus aureus
  subsp. aureus 21269
MLNVLLLIIYLIAICSVNNAYANEENPKIEDLCKKSSVDSTALHNINDDYINNRFTTVKSIVSTTEKFLDFDLLFKSINWLDGKSAEFKDLKVEFSSSEISKEYFGKTVDIYGVYYKAHCHGEHQMNTACTYGGVTPHENNKLSEPKNIGVAVYKDNVNVNTFIVTTDKKKVTAQELDIKVRTKLNNAYKLYDRMTSDVQKGYIKFHSHSEHKESFYYDLFYIKGNLPDQYLQIYNDNKTIDSSDYHIDVYLFT

SEQ ID NO: 34825 - protein, 239 aa, Staphylococcus aureus
  subsp. aureus 21269
MKRILIIVVLLFCYSQNHIATADVGVLNLRNYYGSYPIEDHQNINPDNNRLSHQLVFSMDNSTVTAEFKNVEDVKKFKNRAVDVYGLSYSGYCLKNKYMYGGVTLAGDYLEKSRCIPINLWVNGEHQTISTEKVSTNKKIVTAQEIDTKLRRYLQEEYNIYGFNDTNKGRNYGTKSKFSSGFNTGKISFHLNDGSSFSYDLFDTGTGQAESFLKIYNDNKTVETDKFHLDVEISYKDES

SEQ ID NO: 34826 - protein, 219 aa, Staphylococcus aureus
  subsp. aureus 21269
MKKFKYSFIVVFILFFNVNDFSYAQGDIGVGNLRNFYTKHDYIDLKGLIDKNLPSANQLEFSTGINDLISESNNWDEISKFKGKKLDIFGIDYNGPCKSKYMYGGATLSGQYLNSARKIPINLWVNGKHKTISTDKISTNKKLVTAQEIDVKLRRYLQEEYNIYGHNSTGKGKEYGYKSKFYSGFNKGKVLFHLNDEKSFSYDLFYTGDGVPVSFFENL

SEQ ID NO: 34827 - protein, 261 aa, Staphylococcus aureus
  subsp. aureus 21269
MKLFAFIFICVKSCSLLFMLNGNPRPEQLNKASEFTGLMDNMRYLYDDKHVSETNIKAQEKFLQHDLLFKINGSKIDGSKILKTEFNNKSLSDKYKNKNVDLFGTNYYNQCNFSADNMELNDGRLIEKTCMYGGVTEHDGNQIDKNNLTDNSHNILIKVYENERNTLSFDISTNKKNITAQEIDYKVRNYLLKHKNLYKFNSSPYETGYIKFIEGNGHSFWYDMMPESGEKFYPTKYLLIYNDNKTVESKSINVEVHLTKK

SEQ ID NO: 34828 - protein, 165 aa, Staphylococcus aureus
  subsp. aureus 21269
MKVEFNSADLANQFKGKNIDIYGLYYGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNQQDQSFYYDLYNIKGSVGAEFFQFYSDNRTVSSSNYHIDVFLYKD

SEQ ID NO: 34829 - protein, 205 aa, Staphylococcus aureus
  subsp. aureus 21269
MKKLSTVIIILILEIVFHNINYANAQPDPKIDELNKVSDYKSNKGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKSYTSLMVLHLNLDI

SEQ ID NO: 34830 - protein, 306 aa, Staphylococcus aureus
  subsp. aureus 21269
MLAATLSVGLIAPLASPIQESRANTNIENIGDGAEVIKRMEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 34831 - protein, 327 aa, Staphylococcus aureus
  subsp. aureus 21269
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTATFTSTYEVDWQNHTVKLISTDSKETNPGV

SEQ ID NO: 34832 - protein, 70 aa, Staphylococcus aureus
  subsp. aureus 21269
MNKQQSKVRYSIRKVSIGTFLNGDYDGKLMKFQSLDQNWNNGGWRKAEVANKVVHNYENDMIFIRPFKKA

SEQ ID NO: 34833 - protein, 351 aa, Staphylococcus aureus; identical to SEQ ID NO: 33422
  subsp. aureus 21269

SEQ ID NO: 34834 - protein, 338 aa, Staphylococcus aureus
  subsp. aureus 21269
MIKQLYKNITICSLAISTALTVFPATSYAKINSEIKAVSEKNLDGDTKMYTRTATTSDSQKNITQSLQFNFLTEPNYDKETVFIKAKGTIGSGLRILEPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHDVKFVKVLNDNEKK

SEQ ID NO: 34835 - protein, 274 aa, Staphylococcus aureus
  subsp. aureus 21269
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKNETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34836 - protein, 243 aa, Staphylococcus aureus; identical to SEQ ID NO: 30241
  subsp. aureus 21269

SEQ ID NO: 34837 - protein, 256 aa, Staphylococcus aureus; identical to SEQ ID NO: 30240
  subsp. aureus 21269

SEQ ID NO: 34838 - protein, 84 aa, Staphylococcus aureus
  subsp. aureus 21269
MKVINTYSIRKCNIGVASFIIGSFLFLGVNGNLAEANDERQEVDNGQQQKLNEADNERQEVDNGQQQKLNEANDERQEVDNGQQ

SEQ ID NO: 34839 - protein, 809 aa, Staphylococcus aureus
  subsp. aureus 21269
MTYRMKKWQKLSTITLLMAGVIILNGGEFRSIDKHQIAVANTNVQTPDYEKLRNTWLDVNYGYNKYDEKNDAMKKKFDATEKEAEKLLKEMKTESDRKYLWAGAENLETNSSHMTRTYRNIEKIAEAMKHPKTTLKNDENKKKVKDALEWLHKNAYGKEPDKKVAALTSNFKNKTTGKNTNLNWWDYEIGTPKSLTNTLILLNGDISSDEKKKYTAPIKTFAPESDKILSSVGQPEQAKSGNLVDIAKVKLLESIIEEDKDMTKNSIDSFNKVFTYVQSNATGKERNGFYKDGSYIDHQDVPYTGAYGVVLLEGISQMMPMIKATPFKDSNQNDTTLKSWIDDGFMPLIYKSEMMDLSRGRAISRENETSHSASATVMKSLLRLSDAMDNSTKAKYKKIVKTSVKSDSSYKQNDYLSSYSDIDKMKALMEDSTLSTNDLTQQLKIYNDMDRVTYHNKDLDFALGLSMTSKNVARYESINNENLKGWHTGAGMSYLYNSDVKHYRDNFWATADMKRLAGTTTLDNEILKDTDDKKSSKTFVGGTKFDDQHASIGMDFENQDKTLTAKKSYFILNDKIVFLGTGIKSTDSSKNPVTTIENRKSNGYTLYTDDKQTTASDNQETNSVFLESTNKPKNNIGYHFLNKPKITVTKESHTGKWKEINKSQKSEDKKDEYYEVTQKHSNTDDKYGYVLYPGITKDNFKSKASQVTVVKQDDDFHVVKDNESVWAGVNYSDSAKTFEINGTKVEVKVKGMFILKKKDDKTYECSFYNPESTNTASDIESKISMTGYSITNKNASTTNESGVCFELTK

SEQ ID NO: 34840 - protein, 141 aa, Staphylococcus aureus
  subsp. aureus 21269
MKLKSFVTATLALGLLSSVGAALPSHEASADSNNGYKEMTMDGYHTIPYTISVDGITALHRTYFVFPENKKVLYQEIDSKVKNELASQRGVTTEKINNAQTATYTLTLNDGNKKVVNLKKNDNAKNSIDPSTIKQIQIVVK

SEQ ID NO: 34841 - protein, 1322 aa, Staphylococcus aureus
  subsp. aureus 21269
MNLLKKNKYSIRKYKVGIFSTLIGTVLLLSNPNGAQALTTDNNVQSDTNQATPVNLQDTNVANNRGLANSAQNTPNQSTNQALVNHNNGSIANQATPTSVQSSTPAQNNNHSDANSTATETVSNANNNDVVSNNTTLNVPKRTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNGVTNDTIAEKTIEDGPTLRLFKVPDNVNNLKIQFVPKNDAITDTRGIYQLKDGYKYYDFVDSIGLHSGSHVYVERRTMEPTATNNKEFTVTTSLKNNGNSGASLDTDEFVYKIQLPEGVEYVNNSLTKDFPSNNSGVDVNNMNVTYDATNRVITIKSAGGGTTNSPARLMPDKILDLKFKLRVNNVPTPRTVTFNDTLTYKTYTQDFINSPAESHTVSTNPYTIDIIMNKDALQGEVDRRIQQADYTFASLDIFNDLKRRAQTILAENRNNVPLNKRVSQADIDTLTNQMQHTLIRSVDAENAVNQKADQMEDLVNQNDELTDEEKQAAIQVIEEHKGNIIGDIGDQTTDAGVTRIKDQGIQTLSGDTATPVVKPNAKKAIRDKATKQRAIINATPDATEDEIQDAINQLATDETDAIDNVTNATTNADVETAKNNGINTIGAVVPQVTHKKAARDAINQATATKRQQINSNREATQEEKDAALNELTQATNHALEQINQATTNADVDNAKGDGLNAINPIAPVTVVKQAARDAISHDAQQHIAEINANPDATQEERQAAIDKVNAAVTAANTNILNANTNANVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQTTNATTEEKQVALNQVDQELATAINNINQADTNAEVDQAQQLGTKAINAIQPNIVKKPAALAQINQHYNTKLAEINATPDATNDEKNAAINTLNQDRQQAIESIKQANTNAEVDQAATVAENNIDAVQVDVVKNKQREIKSLLKWRSVLKRLNKHLMQLMKKSRLLLIKSINLKIKHLIKLIKTKQMIK

SEQ ID NO: 34842 - protein, 96 aa, Staphylococcus aureus
  subsp. aureus 21269
MKFPVTINKFENLVSNEFVFYNASKITINDLSIKLKSAMANDQGITKHDIGLAERAVYKVYFKNGSSKYVDLKTKYKDGKVFKATDIKKVDIELKF

SEQ ID NO: 34843 - protein, 478 aa, Staphylococcus aureus
  subsp. aureus 21269
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGAKRVIDLKAGIYTADLINTSEIKAININVDTKKQVEDKKKDKANYQVPYTITVNGTSQNILSNLTFNKNQNISYKDLEGKVKSVLESNRGITDVDLRLSKQAKYTVNFKNGTKKVIDLKAGIYTANLINSSDIKSIDINVDTKKHVENKAKRNYQVPYSINLNGTSTNILSNLSFSNKPWKNYKDLTSQIKSVLKHDRGISEQDLKYAKKAYYTVYFKNGGKRILQLNSKNYTANLVHAKDVKRIEITVKTGPKAKADRYVPYTIAVNGTSTPILSKLKLSQKELISYKYLNDKVKSVLKSERGISDLDLKFAKQAKYTVHFKNGKKQVVNLKSDIFTPNLFSAKDIKKIDIDVKQHTKYKKK

SEQ ID NO: 34844 - protein, 241 aa, Staphylococcus aureus; identical to SEQ ID NO: 30608
  subsp. aureus 21269

SEQ ID NO: 34845 - protein, 241 aa, Staphylococcus aureus; identical to SEQ ID NO: 33402
  subsp. aureus 21269

SEQ ID NO: 34846 - protein, 238 aa, Staphylococcus aureus
  subsp. aureus 21269
MNKNITKNIILTTTLLLLGTVLPQNQKPVFSFYSEAKAYSIAQDETNINELIKYYTQPHFSFSNKWLYQYDNGNIYVELKRYSWSAHISLWGAESWGNINQLKDRYVDVFGLKDKDTDQLWWSYRETFTGGVTPVAKPSDKTYNLFVQYKDKLQTIIGAHKIYQGNKPVLTLKEIDFRAREALIKNKILYNENRNKGKLKITGGGNNFTIDLSKRLHSDLANVYVKNPNKITVDVLFD

SEQ ID NO: 34847 - protein, 99 aa, Staphylococcus aureus
  subsp. aureus 21269
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEERC

SEQ ID NO: 34848 - protein, 206 aa, Staphylococcus aureus
  subsp. aureus 21269
MQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 34849 - protein, 165 aa, Staphylococcus aureus; identical to SEQ ID NO: 31315
  subsp. aureus 21269

SEQ ID NO: 34850 - protein, 105 aa, Staphylococcus aureus
  subsp. aureus 21269
MKKNFIGKSILSIAAISLTVSTFAGESHAQTKAEKYDQYQTNFKKQVNKKVVDAQKAVNLFKRTRTVATHRKAQRAVNLIHFQHSYEKKKLQRQIDLVLKYNTLK

SEQ ID NO: 34851 - protein, 354 aa, Staphylococcus aureus
  subsp. aureus 21269
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSENNTQAVSDNKSQQTNKVTKQNEIHKQGPSKDSKAKELPKTGLTSVDNFISTVAFATLALLGSLSLLLFKRKESK

SEQ ID NO: 34852 - protein, 644 aa, Staphylococcus aureus
  subsp. aureus 21269
MNKQQKEFKSFYSIRKSSLGVASVAISTLLLLMSNGEAQAAEETGGTNTEAQPKTEAVASPSTTTEKAPEAKPVANAVSVSNKEVEAPTSETKEAKEVKEVKAPKETKEVKPATKADNNTYPILNQELREAIKNPAIKDKDHSAPNSRPIDFEMKKKDGTQQFYHYASSVKPARVIFTDSKPEIELGLQSGQFWRKFEVYEGNKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSPSVEKENDASSESGKDKTPATKPAKAEVESSSTTPTKVVSTTQNVAKPTTASSETTIDVVQTSAGSSEAKDSAPLQKANIKNTNDGHTQSENNKNTQENKAKSLPQTGEESNKDMTLPLMALLALSSIVAFVLPRKRKN

SEQ ID NO: 34853 - protein, 227 aa, Staphylococcus aureus
  subsp. aureus 21269
MKLKNIAKASLALGILTTGMITTTAQPVKASTLEARSQATQDLKDYYKGQSFDLKNIGGYKEGNKVTFIYHNQQIDVTLTGKEKLEFNDDEEISNIDVFVVRENSDRSGITNSNGGITYSNKQDNIDNVKSVNMQITKKTSSNTETVTSSYYSIDKENISLKELDFKLRKHLIDNNGLYNTEPKDSKIKVTMKDGGFYTFELNKKLQTHRMGDVIDGRNIEKIEVNL

SEQ ID NO: 34854 - protein, 113 aa, Staphylococcus aureus
  subsp. aureus 21269
DSDSDSDSDSDSDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 34855 - protein, 3059 aa, Staphylococcus aureus
  subsp. aureus 21269
MNYRDKIQKFSIRKYTVGTFSTVIATLVFLGFNTSQAHAAETNQPASVVKQKQQSNNEQTENRESQAQNSQNSQNGQSLSATHENEQPNISQANLVDQKVAQSTTTNDEQPASQNVNTKKDSATAATTQPDKEEIKHKQNESQSANKNGNDSRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPDRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSTNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIQPKDYVVFIPPVGKQIRAVVYYNKVVASNMSNAVTILPDDNPPTINNPVGINAKYYRGDEVNFTMGVSDRHSGLKSTTITTLPSGWTSNLTKSDNKNGSLSITGRVSMNQAFNSDITFKVSATDNVNNTTNDSQSKHVSIHVGKISEDAHPIVLGNTEKVVVVNPTAVSNDEKQRIITAFMNKNQNIRGYLASTDPVTVDNNGNVTLHYRDGSSTTLEATNVMTYEPIVKPEYQTTNAPKTATVTIAKGQSFSIGDIKQYFTLSNGQPIPIGTFTNITSDRTIPTAQEVSQMNAGTQLYHIVASNAYHKDTEDFYISLKIVDVKQPEGDQRVYRTSTYDLTTDEISKVKQAFINANRDVITLAEGDISVTNTSNGANVSTITVNINKGRLTKSFSSNLANMNFLRWVNFPQDYTVTWTNAKIANRPTDGGLSWSDDHKSLIYRYDATLGTQITTNDILTMLKATTTVPGLRNNITGNEKAQAEAGGRPNYRTTGYSQANASSDGQRQYTLNGQVIQILDIINPSNGYGGQPVTNSNTRANHSNATVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPTTSQITGTVDNNHQHVSATAPNVTSATSKTINLLATDTSGNTATTSFNVTVKPLRDKYRVGTSSTAANPVRIANISNNATVSQADQTAIINSLTFTSNAPNRNYATASANEITSKTVSNVSRTGNNANVTVTVTYQDGTTSTVTVPVKHVIPEIVAHSHYTVQGQDFPAGNGSSASDYFKLSNGSAIPDATITWVSGQAPNKDNTLIGEDITVTANILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNDGIKAKSSISMNNVTYTTQDEHGQVVTVTRNESVDSNDSATVTVTPQLQATSEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAINYITFDPNTNTNGITAAWANRQQPNNQQAGVQHLNVDVTYPGISAAKRVPVTVNVYQFEFPQTSYTTTVGGTLASGTQASGYAHMQNANGLPTDGFTYKWNNAATGTNDANWAAMNKPNAAKVVNAKYDVIYNGHTFATSLPAKFVVKDVQPAKPTITESAAGAITITPGANQTVNTYAGNVTTYADKLVIKRNGNVVTTFTRRNNTSPWVKEASAATVAGIAGTNNGITVAAGTFNPADTIQVVATQGSGETISDEQRSDDFTVVAPQPNHANTKIWQNGHIDITPNNPSGHLINPTQAMDIAYTEKMGNGAEHSKTINVVRGQNNQWTIANKPDYVTLDPQTGKVTFNANTIKPNSVITITPKAGTGHSASSNPSTLTAPATHTVNTTEIVKDYGSNVTAAEINNAAQVASKRTATIKNGTAMPTNLAGGSTTTIPVTVTYNDGSSEEVQESIFTKADKRELITAKNHLDDPVSTDGKKPGTITQYNNAIHNAQQQINTAKTEAQQVINNDRATPQQVNAALSKVQAAQTKINEAKALLQNKEDNSQLVTSKNNLQSSVNQVPSTAGMTQQSIDNYNAKKREAETEITAAQRVIDNGDATAQQISDEKHRVDNALTALNQAKHDLTADTHALEQAVQQLNRTGTTTGKKPASITAYNNSIRALQSDLTSAKNSANAIIQKPIRTVQEVQSALTNVNRVNERLTQAINQLVPLADNSALRTAKTKLDEEINKSVTTDGMTQSSIQAYQNAKRAGQTESTNAQNVINNGDATDQQIAAEKAKVEEKYNSLKQAIAGLTPDLAPLQAAKTQLQNDIDQPTSTTGMTSASVATFNEKLSAARTKIQEIDRVLASHPNVATIRQNVTAANAAKTALDRARNGLTVDKAPLENAKNQLQHSIDTQTSTTGMTQDSVNAYNAKLTAARNKVQQINQVLAGSPTVDQINTNTTAANQAKSDLDHARQALTPDKAPLQNAKTQLEQSINQPTDTTGMTTASLNAYNQKL

SEQ ID NO: 34856 - protein, 141 aa, Staphylococcus aureus
  subsp. aureus 21269
DSDSDSDSDSDSDSDSDSDSDSDSDSDSDSDSDSDSDSDSDSDSDSDSDSDSDSDSDSDSDSDSDSDSDSDSDSDSDRDSDAGKHTPVKPMSTTKDHHNKAKALPETGSENNGSNNATLFGGLFAALGSLLLFGRRKKQNK

SEQ ID NO: 34857 - protein, 672 aa, Staphylococcus aureus
  subsp. aureus 21269
MNMKKKEKHAIRKKSIGVASVLVGTLIGFGLLSSKEADASENSVTQSDSASNESKSNDSSSVNAAPKTDNTNVSDTKTTSNTNNGETSVAQNPAQQETIQSASTNATTEETPVTGEATTTATKQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSDSDSDSASDSDSASDSDSDSDSDSDSDSDSDSDSDSDSDSDSDSDSDSDSDSDSDSDSDSDSDSDSD

SEQ ID NO: 34858 - protein, 434 aa, Staphylococcus aureus
  subsp. aureus 21269
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMISLDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 34859 - protein, 325 aa, Staphylococcus aureus; identical to SEQ ID NO: 30407
  subsp. aureus 21269

SEQ ID NO: 34860 - protein, 249 aa, Staphylococcus aureus
  subsp. aureus 21269
MKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 34861 - protein, 321 aa, Staphylococcus aureus; identical to SEQ ID NO: 30959
  subsp. aureus 21269

SEQ ID NO: 34862 - protein, 266 aa, Staphylococcus aureus; identical to SEQ ID NO: 30362
  subsp. aureus 21269

SEQ ID NO: 34863 - protein, 691 aa, Staphylococcus aureus
  subsp. aureus 21269
MLRGQEERKYSIRKYSIGVVSVLAATMFIVSSHEAQASEKTLTSNAAAQKETLNQPGEQGNAITSHQMQSGKQLDDMHKENGKSGTVTEGKDTLQSSKHQSTQNSKTIRTQNDDQVKQDSERQGSKQSHQNNATNKTERQNDQVQNTRHAERNGSQSTTSQSNDVDKSQPSIPAQKVIPNHDKAAPTSTTPPSNDKTAPKSTKAQDATTDKHPNQQDTHQPAHQIIDAKQDDTVRQSERKPQVGDLSKRIDGQKSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATEGKGTQLKAS

SEQ ID NO: 34864 - protein, 233 aa, Staphylococcus aureus; identical to SEQ ID NO: 33414
  subsp. aureus 21269

SEQ ID NO: 34865 - protein, 211 aa, Staphylococcus aureus; identical to SEQ ID NO: 34413
  subsp. aureus 21269

SEQ ID NO: 34866 - protein, 944 aa, Staphylococcus aureus
  subsp. aureus 21269
MIVVGMGQEKEAAASEQNNTTVEESGSSGTESKASETQTTTNNVNTIDETQSYSATSTEQPSQSTQVTTEEAPTTVQAPKVETSRVDLPSEKATDKEIAGTQVDTAQPSNVSEIKPRMKRSADVTAASEKEVVEEAKVTGTDVINKVKVTESSLEGHKQGTNVVNPHNAERVTLKYKWSFEEGIKAGDYFDFTLSNNVETHGISTLHKVPEIKSSADNQVMANGQVINERKIRYTFTDYINNKKDLTAELNLNLFIDPTTVTKQGSQKVEVTLGQNKVSKEFDIKYLDGVKDRMGVTVNGRIDTLNKAEGKFSHFAYVKPNNQSLSSVTVTGQVTSGYKQNAKNPTVKVYKHIGSDELAESVYGDLENTMKFQDVTGEVTLQYTDNGGYSLNFNNLDQSKNYVIKYEGDYDSNTNALEFQTHLLGYYNYYYYNTSNLTWKNGVAFYSNNAKGDGKDKPNDPIIEKSEPIDLNIKSEPPVEKHELTGTIEESNDSKPIDFEYHTAVEGVEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPETPPTPPTPEVPSEPGTPVPPTPEVPAEPGKPVPPAKEEPKKPSKPVEQGKVVTPVIEINEKVKAVAPTKQKQSKKSELPETGGEESTNKGMLFGGLFSILGLALLRRNKKNDKA

SEQ ID NO: 34867 - protein, 1003 aa, Staphylococcus aureus
  subsp. aureus 21269
MIVVGMGQDKEAAASEQKTTTVEENGNSATDNKVSETQTTTTNVNHIEETQSYNATVTEQPSNATQVTTEESPKAVQAPQTAQPANVETVKEEVVKEEAKPQVKETTQPQDNSGDQKQVDLTPKMATQNQAAETQVEVAQPRTVSESKPRVTRSADVVDAKEASDAKVETGTDVTSKVTVESGSIEAPQGNKVEPHAGQRVVLKYKLKFEKGLHKGDYFDFTLSNNVNTYGVSTARKVPEIKNGSVVMATGQLLGNGKIRYTFTDYIDYKVNVTADLEINLFIDPKTVQSNGQQTITSTLNDKETKNTLPIEYNPGVSNSYANVNGSIETFDKGNNKFTHVAYIKPQNGHKSDSVSITGTLTQGSKADGKAPTVKVYEVLKDANELPQSVYANVSDSSMFKDVTEEMKDKLKVENNGNYKLDIEKLEKSYVIHYDGEYLSGSDQVNFRTHMFGYPEQQYKYYYTHLGYKLTWDNGLVLYSNKAKGDGTNGTITESNNMTFDEEYGTGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESIKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPGKPTPPTPEVPAEPGKPVPPAKEEPKKPSKPVEQGKVVTPVIEINERVKAVAPTKQKQSKKSELPETGGEESTNKGMLFGGLFSILGLALLRRNKKNHKA

SEQ ID NO: 34868 - protein, 207 aa, Staphylococcus aureus
  subsp. aureus 21269
MIAVTGSIGIAEVKAKTTGLITENSNDSLKEHYAQKFEVYTNKEVTGVGENYIDAKVDTYNVRTVLYNTDYLKQFKNQDKVNIWGTLYENQQSKVYRGTVVKYDPISKVTNLSYRMNLFVNGHQTKVNPDSLLEVKNKQISLKETDFRIRKYLLEKEHLYSNYNSGELIVEMKNGARHKIDLGDILSDSQEKTFDFDNISHIDIYMK

SEQ ID NO: 34869 - protein, 331 aa, Staphylococcus aureus
  subsp. aureus 21269
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVTAASSNSDNVNYEASATTPAKTSSADTDSEDSEKSSKDEDNQNASKSDKSSVGKSESNEETAPVEPMPHSKPTTSEAPPSQNIHNEDSMYDASTE

SEQ ID NO: 34870 - protein, 681 aa, Staphylococcus aureus
  subsp. aureus 21269
MMKSQNKYSIRKFNVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKETDNSQDSNANNNLPSQSRTKEALPLNKSNQTSQREIVNKTEIEKVQPQQNNQANDKITNYNFNNEKEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 34871 - protein, 2400 aa, Staphylococcus aureus
  subsp. aureus 21269
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASAATTTALTANTITVNKDNLKQYMTTSGNATYDQSTGIVTLTQDTYSQKGAITLGTRIDSNKSFHFSGKVNLGNKYEGHGNGGDGIGFAFSPGVLGKTGLNGAAVGIGGLSNAFGFKLDTYHNTSTPNSSAKAKADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPIKIATQDNSGNAVTNTVTGLPSGLTFDSTNNTISGTPINIGTSTITIVSTDASGNKTTTTFKYEVTRNSMSDSVSTSGSTQQSQSVSTSKADSQSASTSRSGSIMTSTSASTSKSTSVSLSDSVSASKSLSTSESNSVSSSTSTSLVNSQSVSSSMSGSVSKSTSLSDSISNSSSTEKSESVSTSTSDSLRTSTSLSDSVSMSTSGSLSKSQSLSTSTSDSASTSQSVSDSTSNSISTSESLSESGSTSESISISNSISNSVSASTSKSESQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSSSVRMSESQSTSGSVSTSTSLSTSNSERTSTSMSDSTSLSTSESDSISESTSTSDSISEAISASESTSISLSESNSISDSESQSASAFLSESLSVSTSESTSESVSSSTSASTSLSDSTSESGSTSTSLSNSTSGSASISTSTSGSASTSTVKSESVSTSLSTSTSTSLSDSTSLSTSLSDSTSGSKSNSLSASMSTSDSISTRKSESLSASTSLSGSTSESESGSTSSSESKSDSTSMSLSMSQSTSGSTSVLTSESLSDSTSTSLSLSASMNQSGVDSNSASQSASTSTSTSTSESDSQSTSSYTSQSTSQSESTSTSTSLSDSTSISKSTSQSGSTSTSASLSGSESESDSQSISTSTSESKSESTSTSLSDSTSTSNSGSASTSTSLSNSASASESDSSSTSLSDSTSASMQSSESDSQSTSTSNRMSTIASESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESISLSGSQSMSDSVSTSDSSSLSVSTSQRSSESVSESDSLSDSKSTSGSTSTSTSGSLSTSTSLSGSESVSESSSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSASTSESLSDSMAQSQSTSTSASGSLSTSISLSMSASASTSTSQSTSVSTSLSTSDSISDSTSISISGSQSAVESESTSDSTSISDSESLSTSGSDSTSTSTSDSTSTSLSLSTSGSTSDSTSISDSESLSTSDSDSTSTSTSDSTSTSLSLSTSGSTSGSTSTSTSESLSTSNSGSTSVSDSSSTSSSLSTSGSTSVSDSTSMSESNSASISMSQSISGSTSGSTSISTSESLSMSGSTHNSTSVSDSDSISTSNSGSMSNSIRHFTSLSTSGLMSLSDSNSMSNSDSVSMSNSTSTSMSDSTSMSDSESVSTSASTSLSTSNSESASVSMSDSTSTSMSNSTSMSDSDSVSISASESMSASMSDSVSMSDSTSSSMSNSMSMSTSESNSIHPSNSMSTSQTHFTSTSISTSKSIAPNTNESQSTLSATSVSSKHDAEPAQSEERLPDTGDSIKQNGLLGGVMTLLVGLGLMKRKKKKDENDQDDSQA

SEQ ID NO: 34872 - protein, 407 aa, Staphylococcus aureus
  subsp. aureus 21269
MKKKNIYSIRKLGVGIASVTLGTLLISGGVTPAANAAQHDEAQQNAFYQVLNMPNLNADQRNGFIQSLKDDPSQSANVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDGNKPSKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34873 - protein, 259 aa, Staphylococcus aureus
  subsp. aureus 21269
MRKVFILITLLFGYSSYSLLEARAETQNDPNISELNKSSQYTGSWHNIWYLYNSDPVNAKKIKLSDKFLSHDFIVPINNPGHYDYVKTELKDSTMASSFDGKEVDIFGVNYFDQCYFSNENIQCDSNQGGGSKKTCMYGGITLNENNTNNRIQPIVVKVYENDSVTLSFDINIDKETVTIQELDYKVRNKLISKINLYHLGGTSYETGYIKFIENGNRYYWYDMMPDPGFTQSKYLMIYRGNETVESAKTEIEVHLTKK

SEQ ID NO: 34874 - protein, 325 aa, Staphylococcus aureus; identical to SEQ ID NO: 30484
  subsp. aureus 21269

SEQ ID NO: 34875 - protein, 239 aa, Staphylococcus aureus
  subsp. aureus 21269
MILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 34876 - protein, 250 aa, Staphylococcus aureus
  subsp. aureus 21269
MGEFEVKYLTGFILILLLEGILTNSASAIEYSDLHHKSKLNSKRLSNAKMSFINPTQLENKKTNDRLLTHDLLFHDMFLNDASKKDFKVEFENEALSNEFINKNIDIYAGSYSYECHGGETNKTQGSYGGVTLSDNNKYDDYKNIPCNLWIDGHQTEIELTAVKTKKKIVTIQELDVQLRNYLSEKYKLYEKGGDIVKGYVKYHNDDEKNVEYDFYNLNGEYGHEVLKMYADNKTINSDKLHLDIYLFKS

SEQ ID NO: 34877 - protein, 721 aa, Staphylococcus aureus
  subsp. aureus 21269
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPESLTGNGDVDYSNSNNTMPIADIKSTNGNVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVNPKDPTPGPPVDPEPEPEPTPDPEPSPDPDPEPTPDPEPSPEPDPDSDSDSDSGSDSDSGSDSDSDSDSESDSDSDSDSDSDSDSESDSDSDSDSDSDSDSDSESDSDSDSDSDSESDSDSDSDSDSDSDSDSDSDSDSESDSDSDSDSYSDSDSDSDSDSDSDSDSDSDSDSDSESDSD

SEQ ID NO: 34878 - protein, 203 aa, Staphylococcus aureus; identical to SEQ ID NO: 30343
  subsp. aureus 21269

SEQ ID NO: 34879 - protein, 226 aa, Staphylococcus aureus; identical to SEQ ID NO: 33436
  subsp. aureus 21269

SEQ ID NO: 34880 - protein, 231 aa, Staphylococcus aureus
  subsp. aureus 21269
MKMKNIAKISLLLGILATGVNTTTEKPVHAEKKPIVISENSKKLKAYYNQPSIEYKNVTGYISFIQPSIKFMNIIDGNSVNNIALIGKDKQHYYTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 34881 - protein, 369 aa, Staphylococcus aureus
  subsp. aureus 21269
MKMRTIAKTSLALGLLTTCAITVTTQSVKAEKVQSTKVDKVPTLKGERLAMINITTGANTATTQAANTRQERTSKLEKAPNTNEEKTSTSKIEKISQPKQEAQKSLNISATPAPKQEQSQTTTESATPKTKVTTPQSINTQQTKVTTPPSTNTPQPMQSTKSDTPQSPTIKQAQTDMTPKYEDLRSYYTKPSFEFEKQFGFMLKPWTTVRFMNVIPNRFIYKIALVGKDEKKYKDGPYDNIDVFIVLEDNKYQLKKYSVGGITKTNSKKVDHKAELSITQENNQGTISRDVSEYMITKEEISLKELDFKLRKQLIEKHNLYGNMGSGTIVIKMKNGGKYTFELHKKLQEHRMADVIEGTNIDKIEVNIK

SEQ ID NO: 34882 - protein, 279 aa, Staphylococcus aureus
  subsp. aureus 21269
MKITTIAKTSLALGLLTTGVITTTTQAANATTPSSTKVEAPQQAANATTPSSTKVETPQQTPNAPTTPSTKVETPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVNHKAGVRITKEDNKGTISHDVSEFKITKEQISLKELDFKLRKQLIEKNNLYGNVGSGKIVIKMKNGGKYTFELHKKLQEYRMADVIDGTNIDNIEVNIK
